(12) United States Patent
Tang et al.

(10) Patent No.: US 6,919,193 B2
(45) Date of Patent: Jul. 19, 2005

(54) NUCLEIC ACIDS AND POLYPEPTIDES

(75) Inventors: Y. Tom Tang, San Jose, CA (US); Ryle Goodrich, San Jose, CA (US); Chenghua Liu, San Jose, CA (US); Feiyan Ren, Cupertino, CA (US); Dunrui Wang, Poway, CA (US); Radoje T. Drmanac, Palo Alto, CA (US)

(73) Assignee: Nuvelo, Inc., Sunnyvale, CA (US)

( * ) Notice: Subject to any disclaimer, the term of this patent is extended or adjusted under 35 U.S.C. 154(b) by 313 days.

(21) Appl. No.: 10/120,988

(22) Filed: Apr. 10, 2002

(65) Prior Publication Data

US 2003/0219745 A1 Nov. 27, 2003

Related U.S. Application Data

(63) Continuation of application No. 09/774,528, filed on Jan. 30, 2001, now Pat. No. 6,743,619.

(51) Int. Cl.$^7$ .......................... C12N 9/14; C12N 15/00; C07H 21/04; A61K 38/51
(52) U.S. Cl. ...................... 435/195; 435/440; 424/94.6; 536/23.2
(58) Field of Search ................................ 435/195, 440, 435/183; 424/94.6; 536/23.2; 530/350

(56) References Cited

FOREIGN PATENT DOCUMENTS

EP        1033401 A2 *   9/2000

\* cited by examiner

*Primary Examiner*—P. Achutamurthy
*Assistant Examiner*—Yong D. Pak
(74) *Attorney, Agent, or Firm*—Elena Quertermous

(57) ABSTRACT

The present invention provides novel nucleic acids, novel polypeptide sequences encoded by these nucleic acids and uses thereof.

3 Claims, No Drawings

NUCLEIC ACIDS AND POLYPEPTIDES

1. CROSS REFERENCE TO RELATED APPLICATIONS

This application is a continuation of U.S. application Ser. No. 09/774,528, filed Jan. 30, 2001 now U.S. Pat. No. 6,743,619, which is incorporated herein by reference in its entirety.

2. BACKGROUND OF THE INVENTION

2.1 Technical Field

The present invention provides novel polynucleotides and proteins encoded by such polynucleotides, along with uses for these polynucleotides and proteins, for example in therapeutic, diagnostic and research methods.

2.2 Background

Technology aimed at the discovery of protein factors (including e.g., cytokines, such as lymphokines, interferons, CSFs, chemokines, and interleukins) has matured rapidly over the past decade. The now routine hybridization cloning and expression cloning techniques clone novel polynucleotides "directly" in the sense that they rely on information directly related to the discovered protein (i.e., partial DNA/amino acid sequence of the protein in the case of hybridization cloning; activity of the protein in the case of expression cloning). More recent "indirect" cloning techniques such as signal sequence cloning, which isolates DNA sequences based on the presence of a now well-recognized secretory leader sequence motif, as well as various PCR-based or low stringency hybridization-based cloning techniques, have advanced the state of the art by making available large numbers of DNA/amino acid sequences for proteins that are known to have biological activity, for example, by virtue of their secreted nature in the case of leader sequence cloning, by virtue of their cell or tissue source in the case of PCR-based techniques, or by virtue of structural similarity to other genes of known biological activity.

Identified polynucleotide and polypeptide sequences have numerous applications in, for example, diagnostics, forensics, gene mapping; identification of mutations responsible for genetic disorders or other traits, to assess biodiversity, and to produce many other types of data and products dependent on DNA and amino acid sequences.

3. SUMMARY OF THE INVENTION

The compositions of the present invention include novel isolated polypeptides, novel isolated polynucleotides encoding such polypeptides, including recombinant DNA molecules, cloned genes or degenerate variants thereof, especially naturally occurring variants such as allelic variants, antisense polynucleotide molecules, and antibodies that specifically recognize one or more epitopes present on such polypeptides, as well as hybridomas producing such antibodies.

The compositions of the present invention additionally include vectors, including expression vectors, containing the polynucleotides of the invention, cells genetically engineered to contain such polynucleotides and cells genetically engineered to express such polynucleotides.

The present invention relates to a collection or library of at least one novel nucleic acid sequence assembled from expressed sequence tags (ESTs) isolated mainly by sequencing by hybridization (SBH), and in some cases, sequences obtained from one or more public databases. The invention relates also to the proteins encoded by such polynucleotides, along with therapeutic, diagnostic and research utilities for these polynucleotides and proteins. These nucleic acid sequences are designated as SEQ ID NO: 1–441 and are provided in the Sequence Listing. In the nucleic acids provided in the Sequence Listing, A is adenine; C is cytosine; G is guanine; T is thymine; and N is any of the four bases. In the amino acids provided in the Sequence Listing, * corresponds to the stop codon.

The nucleic acid sequences of the present invention also include, nucleic acid sequences that hybridize to the complement of SEQ ID NO: 1–441 under stringent hybridization conditions; nucleic acid sequences which are allelic variants or species homologues of any of the nucleic acid sequences recited above, or nucleic acid sequences that encode a peptide comprising a specific domain or truncation of the peptides encoded by SEQ ID NO: 1–441. A polynucleotide comprising a nucleotide sequence having at least 90% identity to an identifying sequence of SEQ ID NO: 1–441 or a degenerate variant or fragment thereof. The identifying sequence can be 100 base pairs in length.

The nucleic acid sequences of the present invention also include the sequence information from the nucleic acid sequences of SEQ ID NO: 1–441. The sequence information can be a segment of any one of SEQ ID NO: 1–441 that uniquely identifies or represents the sequence information of SEQ ID NO: 1–441.

A collection as used in this application can be a collection of only one polynucleotide. The collection of sequence information or identifying information of each sequence can be provided on a nucleic acid array. In one embodiment, segments of sequence information is provided on a nucleic acid array to detect the polynucleotide that contains the segment. The array can be designed to detect full-match or mismatch to the polynucleotide that contains the segment. The collection can also be provided in a computer-readable format.

This invention also includes the reverse or direct complement of any of the nucleic acid sequences recited above; cloning or expression vectors containing the nucleic acid sequences; and host cells or organisms transformed with these expression vectors. Nucleic acid sequences (or their reverse or direct complements) according to the invention have numerous applications in a variety of techniques known to those skilled in the art of molecular biology, such as use as hybridization probes, use as primers for PCR, use in an array, use in computer-readable media, use in sequencing full-length genes, use for chromosome and gene mapping, use in the recombinant production of protein, and use in the generation of anti-sense DNA or RNA, their chemical analogs and the like.

In a preferred embodiment, the nucleic acid sequences of SEQ ID NO: 1–441 or novel segments or parts of the nucleic acids of the invention are used as primers in expression assays that are well known in the art. In a particularly preferred embodiment, the nucleic acid sequences of SEQ ID NO: 1–441 or novel segments or parts of the nucleic acids provided herein are used in diagnostics for identifying expressed genes or, as well known in the art and exemplified by Vollrath et al., Science 258:52–59 (1992), as expressed sequence tags for physical mapping of the human genome.

The isolated polynucleotides of the invention include, but are not limited to, a polynucleotide comprising any one of the nucleotide sequences set forth in SEQ ID NO: 1–441; a polynucleotide comprising any of the full length protein coding sequences of SEQ ID NO: 1–441; and a polynucleotide comprising any of the nucleotide sequences of the mature protein coding sequences of SEQ ID NO: 1–441. The polynucleotides of the present invention also include, but are not limited to, a polynucleotide that hybridizes under stringent hybridization conditions to (a) the complement of any one of the nucleotide sequences set forth in SEQ ID NO: 1–441; (b) a nucleotide sequence encoding any one of the amino acid sequences set forth in the Sequence Listing; (c) a polynucleotide which is an allelic variant of any polynucleotides recited above; (d) a polynucleotide which encodes a species homolog (e.g. orthologs) of any of the proteins recited above; or (e) a polynucleotide that encodes a polypeptide comprising a specific domain or truncation of any of the polypeptides comprising an amino acid sequence set forth in the Sequence Listing.

The isolated polypeptides of the invention include, but are not limited to, a polypeptide comprising any of the amino acid sequences set forth in the Sequence Listing; or the corresponding full length or mature protein. Polypeptides of the invention also include polypeptides with biological activity that are encoded by (a) any of the polynucleotides having a nucleotide sequence set forth in SEQ ID NO: 1–441; or (b) polynucleotides that hybridize to the complement of the polynucleotides of (a) under stringent hybridization conditions. Biologically or immunologically active variants of any of the polypeptide sequences in the Sequence Listing, and "substantial equivalents" thereof (e.g., with at least about 65%, 70%, 75%, 80%, 85%, 90%, 95%, 98% or 99% amino acid sequence identity) that preferably retain biological activity are also contemplated. The polypeptides of the invention may be wholly or partially chemically synthesized but are preferably produced by recombinant means using the genetically engineered cells (e.g. host cells) of the invention.

The invention also provides compositions comprising a polypeptide of the invention. Polypeptide compositions of the invention may further comprise an acceptable carrier, such as a hydrophilic, e.g., pharmaceutically acceptable, carrier.

The invention also provides host cells transformed or transfected with a polynucleotide of the invention.

The invention also relates to methods for producing a polypeptide of the invention comprising growing a culture of the host cells of the invention in a suitable culture medium under conditions permitting expression of the desired polypeptide, and purifying the polypeptide from the culture or from the host cells. Preferred embodiments include those in which the protein produced by such process is a mature form of the protein.

Polynucleotides according to the invention have numerous applications in a variety of techniques known to those skilled in the art of molecular biology. These techniques include use as hybridization probes, use as oligomers, or primers, for PCR, use for chromosome and gene mapping, use in the recombinant production of protein, and use in generation of anti-sense DNA or RNA, their chemical analogs and the like. For example, when the expression of an mRNA is largely restricted to a particular cell or tissue type, polynucleotides of the invention can be used as hybridization probes to detect the presence of the particular cell or tissue mRNA in a sample using, e.g., in situ hybridization.

In other exemplary embodiments, the polynucleotides are used in diagnostics as expressed sequence tags for identifying expressed genes or, as well known in the art and exemplified by Vollrath et al., Science 258:52–59 (1992), as expressed sequence tags for physical mapping of the human genome.

The polypeptides according to the invention can be used in a variety of conventional procedures and methods that are currently applied to other proteins. For example, a polypeptide of the invention can be used to generate an antibody that specifically binds the polypeptide. Such antibodies, particularly monoclonal antibodies, are useful for detecting or quantitating the polypeptide in tissue. The polypeptides of the invention can also be used as molecular weight markers, and as a food supplement.

Methods are also provided for preventing, treating, or ameliorating a medical condition which comprises the step of administering to a mammalian subject a therapeutically effective amount of a composition comprising a polypeptide of the present invention and a pharmaceutically acceptable carrier.

In particular, the polypeptides and polynucleotides of the invention can be utilized, for example, in methods for the prevention and/or treatment of disorders involving aberrant protein expression or biological activity.

The present invention further relates to methods for detecting the presence of the polynucleotides or polypeptides of the invention in a sample. Such methods can, for example, be utilized as part of prognostic and diagnostic evaluation of disorders as recited herein and for the identification of subjects exhibiting a predisposition to such conditions. The invention provides a method for detecting the polynucleotides of the invention in a sample, comprising contacting the sample with a compound that binds to and forms a complex with the polynucleotide of interest for a period sufficient to form the complex and under conditions sufficient to form a complex and detecting the complex such that if a complex is detected, the polynucleotide of interest is detected. The invention also provides a method for detecting the polypeptides of the invention in a sample comprising contacting the sample with a compound that binds to and forms a complex with the polypeptide under conditions and for a period sufficient to form the complex and detecting the formation of the complex such that if a complex is formed, the polypeptide is detected.

The invention also provides kits comprising polynucleotide probes and/or monoclonal antibodies, and optionally quantitative standards, for carrying out methods of the invention. Furthermore, the invention provides methods for evaluating the efficacy of drugs, and monitoring the progress of patients, involved in clinical trials for the treatment of disorders as recited above.

The invention also provides methods for the identification of compounds that modulate (i.e., increase or decrease) the expression or activity of the polynucleotides and/or polypeptides of the invention. Such methods can be utilized, for example, for the identification of compounds that can ameliorate symptoms of disorders as recited herein. Such methods can include, but are not limited to, assays for identifying compounds and other substances that interact with (e.g., bind to) the polypeptides of the invention. The invention provides a method for identifying a compound that binds to the polypeptides of the invention comprising contacting the compound with a polypeptide of the invention in a cell for a time sufficient to form a polypeptide/compound complex, wherein the complex drives expression of a reporter gene sequence in the cell; and detecting the complex by detecting the reporter gene sequence expression such that if expression of the reporter gene is detected the compound the binds to a polypeptide of the invention is identified.

The methods of the invention also provides methods for treatment which involve the administration of the polynucleotides or polypeptides of the invention to individuals exhibiting symptoms or tendencies. In addition, the invention encompasses methods for treating diseases or disorders as recited herein comprising administering compounds and other substances that modulate the overall activity of the target gene products. Compounds and other substances can effect such modulation either on the level of target gene/protein expression or target protein activity.

The polypeptides of the present invention and the polynucleotides encoding them are also useful for the same functions known to one of skill in the art as the polypeptides and polynucleotides to which they have homology (set forth in Table 2); for which they have a signature region (as set forth in Table 3); or for which they have homology to a gene family (as set forth in Table 4). If no homology is set forth for a sequence, then the polypeptides and polynucleotides of the present invention are useful for a variety of applications, as described herein, including use in arrays for detection.

4. DETAILED DESCRIPTION OF THE INVENTION

4.1 Definitions

It must be noted that as used herein and in the appended claims, the singular forms "a", "an" and "the" include plural references unless the context clearly dictates otherwise.

The term "active" refers to those forms of the polypeptide which retain the biologic and/or immunologic activities of any naturally occurring polypeptide. According to the invention, the terms "biologically active" or "biological activity" refer to a protein or peptide having structural, regulatory or biochemical functions of a naturally occurring molecule. Likewise "immunologically active" or "immunological activity" refers to the capability of the natural, recombinant or synthetic polypeptide to induce a specific immune response in appropriate animals or cells and to bind with specific antibodies.

The term "activated cells" as used in this application are those cells which are engaged in extracellular or intracellular membrane trafficking, including the export of secretory or enzymatic molecules as part of a normal or disease process.

The terms "complementary" or "complementarity" refer to the natural binding of polynucleotides by base pairing. For example, the sequence 5'-AGT-3' binds to the complementary sequence 3'-TCA-5'. Complementarity between two single-stranded molecules may be "partial" such that only some of the nucleic acids bind or it may be "complete" such that total complementarity exists between the single stranded molecules. The degree of complementarity between the nucleic acid strands has significant effects on the efficiency and strength of the hybridization between the nucleic acid strands.

The term "embryonic stem cells (ES)" refers to a cell that can give rise to many differentiated cell types in an embryo or an adult, including the germ cells. The term "germ line stem cells (GSCs)" refers to stem cells derived from primordial stem cells that provide a steady and continuous source of germ cells for the production of gametes. The term "primordial germ cells (PGCs)" refers to a small population of cells set aside from other cell lineages particularly from the yolk sac, mesenteries, or gonadal ridges during embryogenesis that have the potential to differentiate into germ cells and other cells. PGCs are the source from which GSCs and ES cells are derived The PGCs, the GSCs and the ES cells are capable of self-renewal. Thus these cells not only populate the germ line and give rise to a plurality of terminally differentiated cells that comprise the adult specialized organs, but are able to regenerate themselves.

The term "expression modulating fragment," EMF, means a series of nucleotides which modulates the expression of an operably linked ORF or another EMF.

As used herein, a sequence is said to "modulate the expression of an operably linked sequence" when the expression of the sequence is altered by the presence of the EMF. EMFs include, but are not limited to, promoters, and promoter modulating sequences (inducible elements). One class of EMFs are nucleic acid fragments which induce the expression of an operably linked ORF in response to a specific regulatory factor or physiological event.

The terms "nucleotide sequence" or "nucleic acid" or "polynucleotide" or "oligonculeotide" are used interchangeably and refer to a heteropolymer of nucleotides or the sequence of these nucleotides. These phrases also refer to DNA or RNA of genomic or synthetic origin which may be single-stranded or double-stranded and may represent the sense or the antisense strand, to peptide nucleic acid (PNA) or to any DNA-like or RNA-like material. In the sequences herein A is adenine, C is cytosine, T is thymine, G is guanine and N is A, C, G or T (U). It is contemplated that where the polynucleotide is RNA, the T (thymine) in the sequences provided herein is substituted with U (uracil). Generally, nucleic acid segments provided by this invention may be assembled from fragments of the genome and short oligonucleotide linkers, or from a series of oligonucleotides, or from individual nucleotides, to provide a synthetic nucleic acid which is capable of being expressed in a recombinant transcriptional unit comprising regulatory elements derived from a microbial or viral operon, or a eukaryotic gene.

The terms "oligonucleotide fragment" or a "polynucleotide fragment", "portion," or "segment" or "probe" or "primer" are used interchangeably and refer to a sequence of nucleotide residues which are at least about 5 nucleotides, more preferably at least about 7 nucleotides, more preferably at least about 9 nucleotides, more preferably at least about 11 nucleotides and most preferably at least about 17 nucleotides. The fragment is preferably less than about 500 nucleotides, preferably less than about 200 nucleotides, more preferably less than about 100 nucleotides, more preferably less than about 50 nucleotides and most preferably less than 30 nucleotides. Preferably the probe is from about 6 nucleotides to about 200 nucleotides, preferably from about 15 to about 50 nucleotides, more preferably from about 17 to 30 nucleotides and most preferably from about 20 to 25 nucleotides. Preferably the fragments can be used in polymerase chain reaction (PCR), various hybridization procedures or microarray procedures to identify or amplify identical or related parts of mRNA or DNA molecules. A fragment or segment may uniquely identify each polynucleotide sequence of the present invention. Preferably the fragment comprises a sequence substantially similar to any one of SEQ ID NOs:1–441.

Probes may, for example, be used to determine whether specific mRNA molecules are present in a cell or tissue or to isolate similar nucleic acid sequences from chromosomal DNA as described by Walsh et al. (Walsh, P.S. et al., 1992, PCR Methods Appl 1:241–250). They may be labeled by nick translation, Klenow fill-in reaction, PCR, or other methods well known in the art. Probes of the present invention, their preparation and/or labeling are elaborated in Sambrook, J. et al., 1989, Molecular Cloning: A Laboratory Manual, Cold Spring Harbor Laboratory, NY; or Ausubel, F. M. et al., 1989, Current Protocols in Molecular Biology, John Wiley & Sons, New York N.Y., both of which are incorporated herein by reference in their entirety.

The nucleic acid sequences of the present invention also include the sequence information from the nucleic acid sequences of SEQ ID NOs: 1–441. The sequence information can be a segment of any one of SEQ ID NOs: 1–441 that uniquely identifies or represents the sequence information of that sequence of SEQ ID NO: 1–441. One such segment can be a twenty-mer nucleic acid sequence because the probability that a twenty-mer is fully matched in the human genome is 1 in 300. In the human genome, there are three billion base pairs in one set of chromosomes. Because $4^{20}$ possible twenty-mers exist, there are 300 times more twenty-mers than there are base pairs in a set of human chromosomes. Using the same analysis, the probability for a seventeen-mer to be fully matched in the human genome is approximately 1 in 5. When these segments are used in arrays for expression studies, fifteen-mer segments can be used. The probability that the fifteen-mer is fully matched in the expressed sequences is also approximately one in five because expressed sequences comprise less than approximately 5% of the entire genome sequence.

Similarly, when using sequence information for detecting a single mismatch, a segment can be a twenty-five mer. The probability that the twenty-five mer would appear in a human genome with a single mismatch is calculated by multiplying the probability for a full match $(1 \div 4^{25})$ times the increased probability for mismatch at each nucleotide position $(3 \times 25)$. The probability that an eighteen mer with a single mismatch can be detected in an array for expression studies is approximately one in five. The probability that a twenty-mer with a single mismatch can be detected in a human genome is approximately one in five.

The term "open reading frame," ORF, means a series of nucleotide triplets coding for amino acids without any termination codons and is a sequence translatable into protein.

The terms "operably linked" or "operably associated" refer to functionally related nucleic acid sequences. For example, a promoter is operably associated or operably linked with a coding sequence if the promoter controls the transcription of the coding sequence. While operably linked nucleic acid sequences can be contiguous and in the same reading frame, certain genetic elements e.g. repressor genes are not contiguously linked to the coding sequence but still control transcription/translation of the coding sequence.

The term "pluripotent" refers to the capability of a cell to differentiate into a number of differentiated cell types that are present in an adult organism. A pluripotent cell is restricted in its differentiation capability in comparison to a totipotent cell.

The terms "polypeptide" or "peptide" or "amino acid sequence" refer to an oligopeptide, peptide, polypeptide or protein sequence or fragment thereof and to naturally occurring or synthetic molecules. A polypeptide "fragment," "portion," or "segment" is a stretch of amino acid residues of at least about 5 amino acids, preferably at least about 7 amino acids, more preferably at least about 9 amino acids and most preferably at least about 17 or more amino acids. The peptide preferably is not greater than about 200 amino acids, more preferably less than 150 amino acids and most preferably less than 100 amino acids. Preferably the peptide is from about 5 to about 200 amino acids. To be active, any polypeptide must have sufficient length to display biological and/or immunological activity.

The term "naturally occurring polypeptide" refers to polypeptides produced by cells that have not been genetically engineered and specifically contemplates various polypeptides arising from post-translational modifications of the polypeptide including, but not limited to, acetylation, carboxylation, glycosylation, phosphorylation, lipidation and acylation.

The term "translated protein coding portion" means a sequence which encodes for the fill length protein which may include any leader sequence or any processing sequence.

The term "mature protein coding sequence" means a sequence which encodes a peptide or protein without a signal or leader sequence. The "mature protein portion" means that portion of the protein which does not include a signal or leader sequence. The peptide may have been produced by processing in the cell which removes any leader/signal sequence. The mature protein portion may or may not include the initial methionine residue. The methionine residue may be removed from the protein during processing in the cell. The peptide may be produced synthetically or the protein may have been produced using a polynucleotide only encoding for the mature protein coding sequence.

The term "derivative" refers to polypeptides chemically modified by such techniques as ubiquitination, labeling (e.g., with radionuclides or various enzymes), covalent polymer attachment such as pegylation (derivatization with polyethylene glycol) and insertion or substitution by chemical synthesis of amino acids such as ornithine, which do not normally occur in human proteins.

The term "variant" (or "analog") refers to any polypeptide differing from naturally occurring polypeptides by amino acid insertions, deletions, and substitutions, created using, e g., recombinant DNA techniques. Guidance in determining which amino acid residues may be replaced, added or deleted without abolishing activities of interest, may be found by comparing the sequence of the particular polypeptide with that of homologous peptides and minimizing the number of amino acid sequence changes made in regions of high homology (conserved regions) or by replacing amino acids with consensus sequence.

Alternatively, recombinant variants encoding these same or similar polypeptides may be synthesized or selected by making use of the "redundancy" in the genetic code. Various codon substitutions, such as the silent changes which produce various restriction sites, may be introduced to optimize cloning into a plasmid or viral vector or expression in a particular prokaryotic or eukaryotic system. Mutations in the polynucleotide sequence may be reflected in the polypeptide or domains of other peptides added to the polypeptide to modify the properties of any part of the polypeptide, to change characteristics such as ligand-binding affinities, interchain affinities, or degradation/turnover rate.

Preferably, amino acid "substitutions" are the result of replacing one amino acid with another amino acid having similar structural and/or chemical properties, i.e., conservative amino acid replacements. "Conservative" amino acid substitutions may be made on the basis of similarity in polarity, charge, solubility, hydrophobicity, hydrophilicity, and/or the amphipathic nature of the residues involved. For example, nonpolar (hydrophobic) amino acids include alanine, leucine, isoleucine, valine, proline, phenylalanine, tryptophan, and methionine; polar neutral amino acids include glycine, serine, threonine, cysteine, tyrosine, asparagine, and glutamine; positively charged (basic) amino acids include arginine, lysine, and histidine; and negatively charged (acidic) amino acids include aspartic acid and glutamic acid. "Insertions" or "deletions" are preferably in the range of about 1 to 20 amino acids, more preferably 1 to 10 amino acids. The variation allowed may be experimentally determined by systematically making insertions, deletions, or substitutions of amino acids in a polypeptide molecule using recombinant DNA techniques and assaying the resulting recombinant variants for activity.

Alternatively, where alteration of function is desired, insertions, deletions or non-conservative alterations can be engineered to produce altered polypeptides. Such alterations can, for example, alter one or more of the biological functions or biochemical characteristics of the polypeptides of the invention. For example, such alterations may change polypeptide characteristics such as ligand-binding affinities, interchain affinities, or degradation/turnover rate. Further, such alterations can be selected so as to generate polypeptides that are better suited for expression, scale up and the like in the host cells chosen for expression. For example, cysteine residues can be deleted or substituted with another amino acid residue in order to eliminate disulfide bridges.

The terms "purified" or "substantially purified" as used herein denotes that the indicated nucleic acid or polypeptide is present in the substantial absence of other biological macromolecules, e.g., polynucleotides, proteins, and the like. In one embodiment, the polynucleotide or polypeptide is purified such that it constitutes at least 95% by weight, more preferably at least 99% by weight, of the indicated biological macromolecules present (but water, buffers, and other small molecules, especially molecules having a molecular weight of less than 1000 daltons, can be present).

The term "isolated" as used herein refers to a nucleic acid or polypeptide separated from at least one other component (e.g., nucleic acid or polypeptide) present with the nucleic acid or polypeptide in its natural source. In one embodiment, the nucleic acid or polypeptide is found in the presence of (if anything) only a solvent, buffer, ion, or other component normally present in a solution of the same. The terms "isolated" and "purified" do not encompass nucleic acids or polypeptides present in their natural source.

The term "recombinant," when used herein to refer to a polypeptide or protein, means that a polypeptide or protein is derived from recombinant (e.g., microbial, insect, or mammalian) expression systems. "Microbial" refers to recombinant polypeptides or proteins made in bacterial or fungal (e.g., yeast) expression systems. As a product, "recombinant microbial" defines a polypeptide or protein essentially free of native endogenous substances and unaccompanied by associated native glycosylation. Polypeptides or proteins expressed in most bacterial cultures, e.g., E. coli, will be free of glycosylation modifications; polypeptides or proteins expressed in yeast will have a glycosylation pattern in general different from those expressed in mammalian cells.

The term "recombinant expression vehicle or vector" refers to a plasmid or phage or virus or vector, for expressing a polypeptide from a DNA (RNA) sequence. An expression vehicle can comprise a transcriptional unit comprising an assembly of (1) a genetic element or elements having a regulatory role in gene expression, for example, promoters or enhancers, (2) a structural or coding sequence which is transcribed into mRNA and translated into protein, and (3) appropriate transcription initiation and termination sequences. Structural units intended for use in yeast or eukaryotic expression systems preferably include a leader sequence enabling extracellular secretion of translated protein by a host cell. Alternatively, where recombinant protein is expressed without a leader or transport sequence, it may include an amino terminal methionine residue. This residue may or may not be subsequently cleaved from the expressed recombinant protein to provide a final product.

The term "recombinant expression system" means host cells which have stably integrated a recombinant transcriptional unit into chromosomal DNA or carry the recombinant transcriptional unit extrachromosomally. Recombinant expression systems as defined herein will express heterologous polypeptides or proteins upon induction of the regulatory elements linked to the DNA segment or synthetic gene to be expressed. This term also means host cells which have stably integrated a recombinant genetic element or elements having a regulatory role in gene expression, for example, promoters or enhancers. Recombinant expression systems as defined herein will express polypeptides or proteins endogenous to the cell upon induction of the regulatory elements linked to the endogenous DNA segment or gene to be expressed. The cells can be prokaryotic or eukaryotic.

The term "secreted" includes a protein that is transported across or through a membrane, including transport as a result of signal sequences in its amino acid sequence when it is expressed in a suitable host cell. "Secreted" proteins include without limitation proteins secreted wholly (e.g., soluble proteins) or partially (e.g., receptors) from the cell in which they are expressed. "Secreted" proteins also include without limitation proteins that are transported across the membrane of the endoplasmic reticulum. "Secreted" proteins are also intended to include proteins containing non-typical signal sequences (e.g. Interleukin-1 Beta, see Krasney, P. A. and Young, P. R. (1992) Cytokine 4(2):134–143) and factors released from damaged cells (e.g. Interleukin-1 Receptor Antagonist, see Arend, W. P. et. al. (1998) Annu. Rev. Immunol. 16:27–55)

Where desired, an expression vector may be designed to contain a "signal or leader sequence" which will direct the polypeptide through the membrane of a cell. Such a sequence may be naturally present on the polypeptides of the present invention or provided from heterologous protein sources by recombinant DNA techniques.

The term "stringent" is used to refer to conditions that are commonly understood in the art as stringent. Stringent conditions can include highly stringent conditions (i.e., hybridization to filter-bound DNA in 0.5 M $NaHPO_4$, 7% sodium dodecyl sulfate (SDS), 1 mM EDTA at 65° C., and washing in 0.1×SSC/0.1% SDS at 68° C.), and moderately stringent conditions (i.e., washing in 0.2×SSC/0.1% SDS at 42° C.). Other exemplary hybridization conditions are described herein in the examples.

In instances of hybridization of deoxyoligonucleotides, additional exemplary stringent hybridization conditions include washing in 6×SSC/0.05% sodium pyrophosphate at 37° C. (for 14-base oligonucleotides), 48° C. (for 17-base oligos), 55° C. (for 20-base oligonucleotides), and 60° C. (for 23-base oligonucleotides).

As used herein, "substantially equivalent" or "substantially similar" can refer both to nucleotide and amino acid sequences, for example a mutant sequence, that varies from a reference sequence by one or more substitutions, deletions, or additions, the net effect of which does not result in an adverse functional dissimilarity between the reference and subject sequences. Typically, such a substantially equivalent sequence varies from one of those listed herein by no more than about 35% (i.e., the number of individual residue substitutions, additions, and/or deletions in a substantially equivalent sequence, as compared to the corresponding reference sequence, divided by the total number of residues in the substantially equivalent sequence is about 0.35 or less). Such a sequence is said to have 65% sequence identity to the listed sequence. In one embodiment, a substantially equivalent, e.g., mutant, sequence of the invention varies from a listed sequence by no more than 30% (70% sequence identity); in a variation of this embodiment, by no more than 25% (75% sequence identity); and in a further variation of this embodiment, by no more than 20% (80% sequence identity) and in a further variation of this embodiment, by no more than 10% (90% sequence identity) and in a further variation of this embodiment, by no more that 5% (95% sequence identity). Substantially equivalent, e.g., mutant, amino acid sequences according to the invention preferably have at least 80% sequence identity with a listed amino acid sequence, more preferably at least 85% sequence identity, more preferably at least 90% sequence identity, more preferably at least 95% sequence identity, more preferably at least 98% sequence identity, and most preferably at least 99% sequence identity. Substantially equivalent nucleotide sequence of the invention can have lower percent sequence identities, taking into account, for example, the redundancy or degeneracy of the genetic code. Preferably, the nucleotide sequence has at least about 65% identity, more preferably at least about 75% identity, more preferably at least about 80% sequence identity, more preferably at least 85% sequence identity, more preferably at least 90% sequence identity, more preferably at least about 95% sequence identity, more preferably at least 98% sequence identity, and most preferably at least 99% sequence identity. For the purposes of the present invention, sequences having substantially equivalent biological activity and substantially equivalent expression characteristics are considered substantially equivalent. For the purposes of determining equivalence, truncation of the mature sequence (e.g., via a mutation which creates a spurious stop codon) should be disregarded. Sequence identity may be determined, e.g., using the Jotun Hein method (Hein, J. (1990) Methods Enzymol. 183:626–645). Identity between sequences can also be determined by other methods known in the art, e.g. by varying hybridization conditions.

The term "totipotent" refers to the capability of a cell to differentiate into all of the cell types of an adult organism.

The term "transformation" means introducing DNA into a suitable host cell so that the DNA is replicable, either as an extrachromosomal element, or by chromosomal integration. The term "transfection" refers to the taking up of an expression vector by a suitable host cell, whether or not any coding sequences are in fact expressed. The term "infection" refers to the introduction of nucleic acids into a suitable host cell by use of a virus or viral vector.

As used herein, an "uptake modulating fragment," UMF, means a series of nucleotides which mediate the uptake of a linked DNA fragment into a cell. UMFs can be readily identified using known UMFs as a target sequence or target motif with the computer-based systems described below. The presence and activity of a UMF can be confirmed by attaching the suspected UMF to a marker sequence. The resulting nucleic acid molecule is then incubated with an appropriate host under appropriate conditions and the uptake of the marker sequence is determined. As described above, a UMF will increase the frequency of uptake of a linked marker sequence.

Each of the above terms is meant to encompass all that is described for each, unless the context dictates otherwise.

4.2 Nucleic Acids of the Invention

Nucleotide sequences of the invention are set forth in the Sequence Listing.

The isolated polynucleotides of the invention include a polynucleotide comprising the nucleotide sequences of SEQ ID NO: 1–441; a polynucleotide encoding any one of the peptide sequences of SEQ ID NO:1–441; and a polynucleotide comprising the nucleotide sequence encoding the mature protein coding sequence of the polynucleotides of any one of SEQ ID NO: 1–441. The polynucleotides of the present invention also include, but are not limited to, a polynucleotide that hybridizes under stringent conditions to (a) the complement of any of the nucleotides sequences of SEQ ID NO: 1–441; (b) nucleotide sequences encoding any one of the amino acid sequences set forth in the Sequence Listing; (c) a polynucleotide which is an allelic variant of any polynucleotide recited above; (d) a polynucleotide which encodes a species homolog of any of the proteins recited above; or (e) a polynucleotide that encodes a polypeptide comprising a specific domain or truncation of the polypeptides of SEQ ID NO: 1–441. Domains of interest may depend on the nature of the encoded polypeptide; e.g., domains in receptor-like polypeptides include ligand-binding, extracellular, transmembrane, or cytoplasmic domains, or combinations thereof; domains in immunoglobulin-like proteins include the variable immunoglobulin-like domains; domains in enzyme-like polypeptides include catalytic and substrate binding domains; and domains in ligand polypeptides include receptor-binding domains.

The polynucleotides of the invention include naturally occurring or wholly or partially synthetic DNA, e.g., cDNA and genomic DNA, and RNA, e.g., mRNA. The polynucleotides may include all of the coding region of the cDNA or may represent a portion of the coding region of the cDNA.

The present invention also provides genes corresponding to the cDNA sequences disclosed herein. The corresponding genes can be isolated in accordance with known methods using the sequence information disclosed herein. Such methods include the preparation of probes or primers from the disclosed sequence information for identification and/or amplification of genes in appropriate genomic libraries or other sources of genoric materials. Further 5' and 3' sequence can be obtained using methods known in the art. For example, full length cDNA or genomic DNA that corresponds to any of the polynucleotides of SEQ ID NO: 1–441 can be obtained by screening appropriate cDNA or genomic DNA libraries under suitable hybridization conditions using any of the polynucleotides of SEQ ID NO: 1–441 or a portion thereof as a probe. Alternatively, the polynucleotides of SEQ ID NO: 1–441 may be used as the basis for suitable primer(s) that allow identification and/or amplification of genes in appropriate genomic DNA or cDNA libraries.

The nucleic acid sequences of the invention can be assembled from ESTs and sequences (including cDNA and genomic sequences) obtained from one or more public databases, such as dbEST, gbpri, and UniGene. The EST sequences can provide identifying sequence information, representative fragment or segment information, or novel segment information for the full-length gene.

The polynucleotides of the invention also provide polynucleotides including nucleotide sequences that are substantially equivalent to the polynucleotides recited above. Polynucleotides according to the invention can have, e.g., at least about 65%, at least about 70%, at least about 75%, at least about 80%, 81%, 82%, 83%, 84%, more typically at least about 85%, 86%, 87%, 88%, 89%, more typically at least about 90%, 91%, 92%, 93%, 94%, and even more typically at least about 95%, 96%, 97%, 98%, 99% sequence identity to a polynucleotide recited above.

Included within the scope of the nucleic acid sequences of the invention are nucleic acid sequence fragments that hybridize under stringent conditions to any of the nucleotide sequences of SEQ ID NO: 1–441, or complements thereof, which fragment is greater than about 5 nucleotides, preferably 7 nucleotides, more preferably greater than 9 nucleotides and most preferably greater than 17 nucleotides. Fragments of, e.g. 15, 17, or 20 nucleotides or more that are selective for (i.e. specifically hybridize to any one of the polynucleotides of the invention) are contemplated. Probes capable of specifically hybridizing to a polynucleotide can differentiate polynucleotide sequences of the invention from other polynucleotide sequences in the same family of genes or can differentiate human genes from genes of other species, and are preferably based on unique nucleotide sequences.

The sequences falling within the scope of the present invention are not limited to these specific sequences, but also include allelic and species variations thereof. Allelic and species variations can be routinely determined by comparing the sequence provided in SEQ ID NO: 1–441, a representative fragment thereof, or a nucleotide sequence at least 90% identical, preferably 95% identical, to SEQ ID NOs: 1–441 with a sequence from another isolate of the same species. Furthermore, to accommodate codon variability, the invention includes nucleic acid molecules coding for the same amino acid sequences as do the specific ORFs disclosed herein. In other words, in the coding region of an ORF, substitution of one codon for another codon that encodes the same amino acid is expressly contemplated.

The nearest neighbor or homology result for the nucleic acids of the present invention, including SEQ ID NOs: 1–441, can be obtained by searching a database using an algorithm or a program. Preferably, a BLAST which stands for Basic Local Alignment Search Tool is used to search for local sequence alignments (Altshul, S. F. J Mol. Evol. 36 290–300 (1993) and Altschul S. F. et al. J. Mol. Biol. 21:403–410 (1990)). Alternatively a FASTA version 3 search against Genpept, using Fastxy algorithm.

Species homologs (or orthologs) of the disclosed polynucleotides and proteins are also provided by the present invention. Species homologs may be isolated and identified by making suitable probes or primers from the sequences provided herein and screening a suitable nucleic acid source from the desired species.

The invention also encompasses allelic variants of the disclosed polynucleotides or proteins; that is, naturally-occurring alternative forms of the isolated polynucleotide which also encode proteins which are identical, homologous or related to that encoded by the polynucleotides.

The nucleic acid sequences of the invention are further directed to sequences which encode variants of the described nucleic acids. These amino acid sequence variants may be prepared by methods known in the art by introducing appropriate nucleotide changes into a native or variant polynucleotide. There are two variables in the construction of amino acid sequence variants: the location of the mutation and the nature of the mutation. Nucleic acids encoding the amino acid sequence variants are preferably constructed by mutating the polynucleotide to encode an amino acid sequence that does not occur in nature. These nucleic acid alterations can be made at sites that differ in the nucleic acids from different species (variable positions) or in highly conserved regions (constant regions). Sites at such locations will typically be modified in series, e.g., by substituting first with conservative choices (e.g., hydrophobic amino acid to a different hydrophobic amino acid) and then with more distant choices (e.g., hydrophobic amino acid to a charged amino acid), and then deletions or insertions may be made at the target site. Amino acid sequence deletions generally range from about 1 to 30 residues, preferably about 1 to 10 residues, and are typically contiguous. Amino acid insertions include amino- and/or carboxyl-terminal fusions ranging in length from one to one hundred or more residues, as well as intrasequence insertions of single or multiple amino acid residues. Intrasequence insertions may range generally from about 1 to 10 amino residues, preferably from 1 to 5 residues. Examples of terminal insertions include the heterologous signal sequences necessary for secretion or for intracellular targeting in different host cells and sequences such as FLAG or poly-histidine sequences useful for purifying the expressed protein.

In a preferred method, polynucleotides encoding the novel amino acid sequences are changed via site-directed mutagenesis. This method uses oligonucleotide sequences to alter a polynucleotide to encode the desired amino acid variant, as well as sufficient adjacent nucleotides on both sides of the changed amino acid to form a stable duplex on either side of the site of being changed. In general, the techniques of site-directed mutagenesis are well known to those of skill in the art and this technique is exemplified by publications such as, Edelman et al., *DNA* 2:183 (1983). A versatile and efficient method for producing site-specific changes in a polynucleotide sequence was published by Zoller and Smith, *Nucleic Acids Res.* 10:6487–6500 (1982). PCR may also be used to create amino acid sequence variants of the novel nucleic acids. When small amounts of template DNA are used as starting material, primer(s) that differs slightly in sequence from the corresponding region in the template DNA can generate the desired amino acid variant. PCR amplification results in a population of product DNA fragments that differ from the polynucleotide template encoding the polypeptide at the position specified by the primer. The product DNA fragments replace the corresponding region in the plasmid and this gives a polynucleotide encoding the desired amino acid variant.

A further technique for generating amino acid variants is the cassette mutagenesis technique described in Wells et al., *Gene* 34:315 (1985); and other mutagenesis techniques well known in the art, such as, for example, the techniques in Sambrook et al., supra, and *Current Protocols in Molecular Biology*, Ausubel et al. Due to the inherent degeneracy of the genetic code, other DNA sequences which encode substantially the same or a functionally equivalent amino acid sequence may be used in the practice of the invention for the cloning and expression of these novel nucleic acids. Such DNA sequences include those which are capable of hybridizing to the appropriate novel nucleic acid sequence under stringent conditions.

Polynucleotides encoding preferred polypeptide truncations of the invention can be used to generate polynucleotides encoding chimeric or fusion proteins comprising one or more domains of the invention and heterologous protein sequences.

The polynucleotides of the invention additionally include the complement of any of the polynucleotides recited above. The polynucleotide can be DNA (genomic, cDNA, amplified, or synthetic) or RNA. Methods and algorithms for obtaining such polynucleotides are well known to those of skill in the art and can include, for example, methods for determining hybridization conditions that can routinely isolate polynucleotides of the desired sequence identities.

In accordance with the invention, polynucleotide sequences comprising the mature protein coding sequences corresponding to any one of SEQ ID NO: 1–441, or functional equivalents thereof, may be used to generate recombinant DNA molecules that direct the expression of that nucleic acid, or a functional equivalent thereof, in appropriate host cells. Also included are the cDNA inserts of any of the clones identified herein.

A polynucleotide according to the invention can be joined to any of a variety of other nucleotide sequences by well-established recombinant DNA techniques (see Sambrook J et al. (1989) Molecular Cloning: A Laboratory Manual, Cold Spring Harbor Laboratory, NY). Useful nucleotide sequences for joining to polynucleotides include an assortment of vectors, e.g., plasmids, cosmids, lambda phage derivatives, phagemids, and the like, that are well known in the art. Accordingly, the invention also provides a vector including a polynucleotide of the invention and a host cell containing the polynucleotide. In general, the vector contains an origin of replication functional in at least one organism, convenient restriction endonuclease sites, and a selectable marker for the host cell. Vectors according to the invention include expression vectors, replication vectors, probe generation vectors, and sequencing vectors. A host cell according to the invention can be a prokaryotic or eukaryotic cell and can be a unicellular organism or part of a multicellular organism.

The present invention further provides recombinant constructs comprising a nucleic acid having any of the nucleotide sequences of SEQ ID NOs: 1–441 or a fragment thereof or any other polynucleotides of the invention. In one embodiment, the recombinant constructs of the present invention comprise a vector, such as a plasmid or viral vector, into which a nucleic acid having any of the nucleotide sequences of SEQ ID NOs: 1–441 or a fragment thereof is inserted, in a forward or reverse orientation. In the case of a vector comprising one of the ORFs of the present invention, the vector may further comprise regulatory sequences, including for example, a promoter, operably linked to the ORF. Large numbers of suitable vectors and promoters are known to those of skill in the art and are commercially available for generating the recombinant constructs of the present invention. The following vectors are provided by way of example. Bacterial: pBs, phagescript, PsiX174, pBluescript SK, pBs KS, pNH8a, pNH16a, pNH18a, pNH46a (Stratagene); pTrc99A, pKK223-3, pKK233-3, pDR540, pRIT5 (Pharmacia). Eukaryotic: pWLneo, pSV2cat, pOG44, PXTI, pSG (Stratagene) pSVK3, pBPV, pMSG, pSVL (Pharmacia).

The isolated polynucleotide of the invention may be operably linked to an expression control sequence such as the pMT2 or pED expression vectors disclosed in Kaufman et al., *Nucleic Acids Res.* 19, 4485–4490 (1991), in order to produce the protein recombinantly. Many suitable expression control sequences are known in the art. General methods of expressing recombinant proteins are also known and are exemplified in R. Kaufman, *Methods in Enzymology* 185, 537–566 (1990). As defined herein "operably linked" means that the isolated polynucleotide of the invention and an expression control sequence are situated within a vector or cell in such a way that the protein is expressed by a host cell which has been transformed (transfected) with the ligated polynucleotide/expression control sequence.

Promoter regions can be selected from any desired gene using CAT (chloramphenicol transferase) vectors or other vectors with selectable markers. Two appropriate vectors are pKK232-8 and pCM7. Particular named bacterial promoters include lacI, lacZ, T3, T7, gpt, lambda PR, and trc. Eukaryotic promoters include CMV immediate early, HSV thymidine kinase, early and late SV40, LTRs from retrovirus, and mouse metallothionein-I. Selection of the appropriate vector and promoter is well within the level of ordinary skill in the art. Generally, recombinant expression vectors will include origins of replication and selectable markers permitting transformation of the host cell, e.g., the ampicillin resistance gene of *E. coli* and *S. cerevisiae* TRP1 gene, and a promoter derived from a highly-expressed gene to direct transcription of a downstream structural sequence. Such promoters can be derived from operons encoding glycolytic enzymes such as 3-phosphoglycerate kinase (PGK), a-factor, acid phosphatase, or heat shock proteins, among others. The heterologous structural sequence is assembled in appropriate phase with translation initiation and termination sequences, and preferably, a leader sequence capable of directing secretion of translated protein into the periplasmic space or extracellular medium. Optionally, the heterologous sequence can encode a fusion protein including an amino terminal identification peptide imparting desired characteristics, e.g., stabilization or simplified purification of expressed recombinant product. Useful expression vectors for bacterial use are constructed by inserting a structural DNA sequence encoding a desired protein together with suitable translation initiation and termination signals in operable reading phase with a functional promoter. The vector will comprise one or more phenotypic selectable markers and an origin of replication to ensure maintenance of the vector and to, if desirable, provide amplification within the host. Suitable prokaryotic hosts for transformation include *E. coli, Bacillus subtilis, Salmonella typhimurium* and various species within the genera *Pseudomonas, Streptomyces,* and *Staphylococcus,* although others may also be employed as a matter of choice.

As a representative but non-limiting example, useful expression vectors for bacterial use can comprise a selectable marker and bacterial origin of replication derived from commercially available plasmids comprising genetic elements of the well known cloning vector pBR322 (ATCC 37017). Such commercial vectors include, for example, pKK223-3 (Pharmacia Fine Chemicals, Uppsala, Sweden) and GEM 1 (Promega Biotech, Madison, Wis., USA). These pBR322 "backbone" sections are combined with an appropriate promoter and the structural sequence to be expressed. Following transformation of a suitable host strain and growth of the host strain to an appropriate cell density, the selected promoter is induced or derepressed by appropriate means (e.g., temperature shift or chemical induction) and cells are cultured for an additional period. Cells are typically harvested by centrifugation, disrupted by physical or chemical means, and the resulting crude extract retained for further purification.

Polynucleotides of the invention can also be used to induce immune responses. For example, as described in Fan et al., *Nat. Biotech.* 17:870–872 (1999), incorporated herein by reference, nucleic acid sequences encoding a polypeptide may be used to generate antibodies against the encoded polypeptide following topical administration of naked plasmid DNA or following injection, and preferably intramuscular injection of the DNA. The nucleic acid sequences are preferably inserted in a recombinant expression vector and may be in the form of naked DNA.

4.3 Antisense

Another aspect of the invention pertains to isolated antisense nucleic acid molecules that are hybridizable to or complementary to the nucleic acid molecule comprising the nucleotide sequence of SEQ ID NO: 1–441, or fragments, analogs or derivatives thereof. An "antisense" nucleic acid comprises a nucleotide sequence that is complementary to a "sense" nucleic acid encoding a protein, e.g., complementary to the coding strand of a double-stranded cDNA molecule or complementary to an mRNA sequence. In specific aspects, antisense nucleic acid molecules are provided that comprise a sequence complementary to at least about 10, 25, 50, 100, 250 or 500 nucleotides or an entire coding strand, or to only a portion thereof. Nucleic acid molecules encoding fragments, homologs, derivatives and analogs of a protein of any of SEQ ID NO: 1–441 or antisense nucleic acids complementary to a nucleic acid sequence of SEQ ID NO: 1–441 are additionally provided.

In one embodiment, an antisense nucleic acid molecule is antisense to a "coding region" of the coding strand of a nucleotide sequence of the invention. The term "coding region" refers to the region of the nucleotide sequence comprising codons which are translated into amino acid residues. In another embodiment, the antisense nucleic acid molecule is antisense to a "noncoding region" of the coding strand of a nucleotide sequence of the invention. The term "noncoding region" refers to 5' and 3' sequences that flank the coding region that are not translated into amino acids (i.e., also referred to as 5' and 3' untranslated regions).

Given the coding strand sequences encoding a nucleic acid disclosed herein (e.g., SEQ ID NO: 1–441, antisense nucleic acids of the invention can be designed according to the rules of Watson and Crick or Hoogsteen base pairing. The antisense nucleic acid molecule can be complementary to the entire coding region of an mRNA, but more preferably is an oligonucleotide that is antisense to only a portion of the coding or noncoding region of an mRNA. For example, the antisense oligonucleotide can be complementary to the region surrounding the translation start site of an mRNA. An antisense oligonucleotide can be, for example, about 5, 10, 15, 20, 25, 30, 35, 40, 45 or 50 nucleotides in length. An antisense nucleic acid of the invention can be constructed using chemical synthesis or enzymatic ligation reactions using procedures known in the art. For example, an antisense nucleic acid (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used.

Examples of modified nucleotides that can be used to generate the antisense nucleic acid include: 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxynracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl)uracil, (acp3) w, and 2,6-diaminopurine. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest, described further in the following subsection).

The antisense nucleic acid molecules of the invention are typically administered to a subject or generated in situ such that they hybridize with or bind to cellular mRNA and/or genomic DNA encoding a protein according to the invention to thereby inhibit expression of the protein, e.g., by inhibiting transcription and/or translation. The hybridization can be by conventional nucleotide complementarity to form a stable duplex, or, for example, in the case of an antisense nucleic acid molecule that binds to DNA duplexes, through specific interactions in the major groove of the double helix. An example of a route of administration of antisense nucleic acid molecules of the invention includes direct injection at a tissue site. Alternatively, antisense nucleic acid molecules can be modified to target selected cells and then administered systemically. For example, for systemic administration, antisense molecules can be modified such that they specifically bind to receptors or antigens expressed on a selected cell surface, e.g., by linking the antisense nucleic acid molecules to peptides or antibodies that bind to cell surface receptors or antigens. The antisense nucleic acid molecules can also be delivered to cells using the vectors described herein. To achieve sufficient intracellular concentrations of antisense molecules, vector constructs in which the antisense nucleic acid molecule is placed under the control of a strong pol II or pol III promoter are preferred.

In yet another embodiment, the antisense nucleic acid molecule of the invention is an α-anomeric nucleic acid molecule. An α-anomeric nucleic acid molecule forms specific double-stranded hybrids with complementary RNA in which, contrary to the usual α-units, the strands run parallel to each other (Gaultier et al. (1987) Nucleic Acids Res 15: 6625–6641). The antisense nucleic acid molecule can also comprise a 2'-o-methylribonucleotide (Inoue et al. (1987) Nucleic Acids Res 15: 6131–6148) or a chimeric RNA-DNA analogue (Inoue et al. (1987) FEBS Lett 215: 327–330).

4.4 Ribozymes and PNA Moieties

In still another embodiment, an antisense nucleic acid of the invention is a ribozyme. Ribozymes are catalytic RNA molecules with ribonuclease activity that are capable of cleaving a single-stranded nucleic acid, such as an mRNA, to which they have a complementary region. Thus, ribozymes (e.g., hammerhead ribozymes (described in Haselhoff and Gerlach (1988) Nature 334:585–591)) can be used to catalytically cleave mRNA transcripts to thereby inhibit translation of an mRNA. A ribozyme having specificity for a nucleic acid of the invention can be designed based upon the nucleotide sequence of a DNA disclosed herein (i.e., SEQ ID NO: 1–441). For example, a derivative of Tetrahymena L-19 IVS RNA can be constructed in which the nucleotide sequence of the active site is complementary to the nucleotide sequence to be cleaved in a SECX-encoding mRNA. See, e.g., Cech et al. U.S. Pat. No. 4,987,071; and Cech et al. U.S. Pat. No. 5,116,742. Alternatively, SECX mRNA can be used to select a catalytic RNA having a specific ribonuclease activity from a pool of RNA molecules. See, e.g., Bartel et al., (1993) Science 261:1411–1418.

Alternatively, gene expression can be inhibited by targeting nucleotide sequences complementary to the regulatory region (e.g., promoter and/or enhancers) to form triple helical structures that prevent transcription of the gene in target cells. See generally, Helene. (1991) Anticancer Drug Des. 6: 569–84; Helene. et al. (1992) Ann. N.Y. Acad. Sci. 660:27–36; and Maher (1992) Bioassays 14: 807–15.

In various embodiments, the nucleic acids of the invention can be modified at the base moiety, sugar moiety or phosphate backbone to improve, e.g., the stability, hybridization, or solubility of the molecule. For example, the deoxyribose phosphate backbone of the nucleic acids can be modified to generate peptide nucleic acids (see Hyrup et al. (1996) Bioorg Med Chem 4: 5–23). As used herein, the terms "peptide nucleic acids" or "PNAs" refer to nucleic acid mimics, e.g., DNA mimics, in which the deoxyribose phosphate backbone is replaced by a pseudopeptide backbone and only the four natural nucleobases are retained. The neutral backbone of PNAs has been shown to allow for specific hybridization to DNA and RNA under conditions of low ionic strength. The synthesis of PNA oligomers can be performed using standard solid phase peptide synthesis protocols as described in Hyrup et al. (1996) above; Perry-O'Keefe et al. (1996) PNAS93: 14670–675.

PNAs of the invention can be used in therapeutic and diagnostic applications. For example, PNAs can be used as antisense or antigene agents for sequence-specific modulation of gene expression by, e.g., inducing transcription or translation arrest or inhibiting replication. PNAs of the invention can also be used, e.g., in the analysis of single base pair mutations in a gene by, e.g., PNA directed PCR clamping; as artificial restriction enzymes when used in combination with other enzymes, e.g., S1 nucleases (Hyrup B. (1996) above); or as probes or primers for DNA sequence and hybridization (Hyrup et al. (1996), above; Perry-O'Keefe (1996), above).

In another embodiment, PNAs of the invention can be modified, e.g., to enhance their stability or cellular uptake, by attaching lipophilic or other helper groups to PNA, by the formation of PNA-DNA chimeras, or by the use of liposomes or other techniques of drug delivery known in the art. For example, PNA-DNA chimeras can be generated that may combine the advantageous properties of PNA and DNA. Such chimeras allow DNA recognition enzymes, e.g., RNase H and DNA polymerases, to interact with the DNA portion while the PNA portion would provide high binding affinity and specificity. PNA-DNA chimeras can be linked using linkers of appropriate lengths selected in terms of base stacking, number of bonds between the nucleobases, and orientation (Hyrup (1996) above). The synthesis of PNA-DNA chimeras can be performed as described in Hyrup (1996) above and Finn et al. (1996) Nucl Acids Res 24: 3357–63. For example, a DNA chain can be synthesized on a solid support using standard phosphoramidite coupling chemistry, and modified nucleoside analogs, e.g., 5'-(4-methoxytrityl)amino-5'-deoxy-thymidine phosphoramidite, can be used between the PNA and the 5' end of DNA (Mag et al. (1989) Nucl Acid Res 17: 5973–88). PNA monomers are then coupled in a stepwise manner to produce a chimeric molecule with a 5' PNA segment and a 3' DNA segment (Finn et al. (1996) above). Alternatively, chimeric molecules can be synthesized with a 5' DNA segment and a 3' PNA segment. See, Petersen et al. (1975) Bioorg Med Chem Lett 5: 1119–11124.

In other embodiments, the oligonucleotide may include other appended groups such as peptides (e.g., for targeting host cell receptors in vivo), or agents facilitating transport across the cell membrane (see, e.g., Letsinger et al., 1989, Proc. Natl. Acad. Sci. U.S.A. 86:6553–6556; Lemaitre et al., 1987, Proc. Natl. Acad. Sci. 84:648–652; PCT Publication No. W088/098 10) or the blood-brain barrier (see, e.g., PCT Publication No. W089/10134). In addition, oligonucleotides can be modified with hybridization triggered cleavage agents (See, e.g., Krol et al., 1988, BioTechniques 6:958–976) or intercalating agents. (See, e.g., Zon, 1988, Pharm. Res. 5: 539–549). To this end, the oligonucleotide may be conjugated to another molecule, e.g., a peptide, a hybridization triggered cross-linking agent, a transport agent, a hybridization-triggered cleavage agent, etc.

4.5 Hosts

The present invention further provides host cells genetically engineered to contain the polynucleotides of the invention. For example, such host cells may contain nucleic acids of the invention introduced into the host cell using known transformation, transfection or infection methods. The present invention still further provides host cells genetically engineered to express the polynucleotides of the invention, wherein such polynucleotides are in operative association with a regulatory sequence heterologous to the host cell which drives expression of the polynucleotides in the cell.

Knowledge of nucleic acid sequences allows for modification of cells to permit, or increase, expression of endogenous polypeptide. Cells can be modified (e.g., by homologous recombination) to provide increased polypeptide expression by replacing, in whole or in part, the naturally occurring promoter with all or part of a heterologous promoter so that the cells express the polypeptide at higher levels. The heterologous promoter is inserted in such a manner that it is operatively linked to the encoding sequences. See, for example, PCT International Publication No. WO94/12650, PCT International Publication No. WO92/20808, and PCT International Publication No. WO91/09955. It is also contemplated that, in addition to heterologous promoter DNA, amplifiable marker DNA (e.g., ada, dhfr, and the multifunctional CAD gene which encodes carbamyl phosphate synthase, aspartate transcarbamylase, and dihydroorotase) and/or intron DNA may be inserted along with the heterologous promoter DNA. If linked to the coding sequence, amplification of the marker DNA by standard selection methods results in co-amplification of the desired protein coding sequences in the cells.

The host cell can be a higher eukaryotic host cell, such as a mammalian cell, a lower eukaryotic host cell, such as a yeast cell, or the host cell can be a prokaryotic cell, such as a bacterial cell. Introduction of the recombinant construct into the host cell can be effected by calcium phosphate transfection, DEAE, dextran mediated transfection, or electroporation (Davis, L. et al., Basic Methods in Molecular Biology (1986)). The host cells containing one of the polynucleotides of the invention, can be used in conventional manners to produce the gene product encoded by the isolated fragment (in the case of an ORF) or can be used to produce a heterologous protein under the control of the EMF.

Any host/vector system can be used to express one or more of the ORFs of the present invention. These include, but are not limited to, eukaryotic hosts such as HeLa cells, Cv-1 cell, COS cells, 293 cells, and Sf9 cells, as well as prokaryotic host such as E. coli and B. subtilis. The most preferred cells are those which do not normally express the particular polypeptide or protein or which expresses the polypeptide or protein at low natural level. Mature proteins can be expressed in mammalian cells, yeast, bacteria, or other cells under the control of appropriate promoters. Cell-free translation systems can also be employed to produce such proteins using RNAs derived from the DNA constructs of the present invention. Appropriate cloning and expression vectors for use with prokaryotic and eukaryotic hosts are described by Sambrook, et al., in Molecular Cloning: A Laboratory Manual, Second Edition, Cold Spring Harbor, N.Y. (1989), the disclosure of which is hereby incorporated by reference.

Various mammalian cell culture systems can also be employed to express recombinant protein. Examples of mammalian expression systems include the COS-7 lines of monkey kidney fibroblasts, described by Gluzman, Cell 23:175 (1981). Other cell lines capable of expressing a compatible vector are, for example, the C127, monkey COS cells, Chinese Hamster Ovary (CHO) cells, human kidney 293 cells, human epidermal A431 cells, human Colo205 cells, 3T3 cells, CV-1 cells, other transformed primate cell lines, normal diploid cells, cell strains derived from in vitro culture of primary tissue, primary explants, HeLa cells, mouse L cells, BHK, HL-60, U937, HaK or Jurkat cells. Mammalian expression vectors will comprise an origin of replication, a suitable promoter and also any necessary ribosome binding sites, polyadenylation site, splice donor and acceptor sites, transcriptional termination sequences, and 5' flanking nontranscribed sequences. DNA sequences derived from the SV40 viral genome, for example, SV40 origin, early promoter, enhancer, splice, and polyadenylation sites may be used to provide the required nontranscribed genetic elements. Recombinant polypeptides and proteins produced in bacterial culture are usually isolated by initial extraction from cell pellets, followed by one or more salting-out, aqueous ion exchange or size exclusion chromatography steps. Protein refolding steps can be used, as necessary, in completing configuration of the mature protein. Finally, high performance liquid chromatography (HPLC) can be employed for final purification steps. Microbial cells employed in expression of proteins can be disrupted by any convenient method, including freeze-thaw cycling, sonication, mechanical disruption, or use of cell lysing agents.

Alternatively, it may be possible to produce the protein in lower eukaryotes such as yeast or insects or in prokaryotes such as bacteria. Potentially suitable yeast strains include *Saccharomyces cerevisiae, Schizosaccharomyces pombe, Kluyveromyces* strains, *Candida*, or any yeast strain capable of expressing heterologous proteins. Potentially suitable bacterial strains include *Escherichia coli, Bacillus subtilis, Salmonella typhimurium*, or any bacterial strain capable of expressing heterologous proteins. If the protein is made in yeast or bacteria, it may be necessary to modify the protein produced therein, for example by phosphorylation or glycosylation of the appropriate sites, in order to obtain the functional protein. Such covalent attachments may be accomplished using known chemical or enzymatic methods.

In another embodiment of the present invention, cells and tissues may be engineered to express an endogenous gene comprising the polynucleotides of the invention under the control of inducible regulatory elements, in which case the regulatory sequences of the endogenous gene may be replaced by homologous recombination. As described herein, gene targeting can be used to replace a gene's existing regulatory region with a regulatory sequence isolated from a different gene or a novel regulatory sequence synthesized by genetic engineering methods. Such regulatory sequences may be comprised of promoters, enhancers, scaffold-attachment regions, negative regulatory elements, transcriptional initiation sites, regulatory protein binding sites or combinations of said sequences. Alternatively, sequences which affect the structure or stability of the RNA or protein produced may be replaced, removed, added, or otherwise modified by targeting. These sequence include polyadenylation signals, mRNA stability elements, splice sites, leader sequences for enhancing or modifying transport or secretion properties of the protein, or other sequences which alter or improve the function or stability of protein or RNA molecules.

The targeting event may be a simple insertion of the regulatory sequence, placing the gene under the control of the new regulatory sequence, e.g., inserting a new promoter or enhancer or both upstream of a gene. Alternatively, the targeting event may be a simple deletion of a regulatory element, such as the deletion of a tissue-specific negative regulatory element. Alternatively, the targeting event may replace an existing element; for example, a tissue-specific enhancer can be replaced by an enhancer that has broader or different cell-type specificity than the naturally occurring elements. Here, the naturally occurring sequences are deleted and new sequences are added. In all cases, the identification of the targeting event may be facilitated by the use of one or more selectable marker genes that are contiguous with the targeting DNA, allowing for the selection of cells in which the exogenous DNA has integrated into the host cell genome. The identification of the targeting event may also be facilitated by the use of one or more marker genes exhibiting the property of negative selection, such that the negatively selectable marker is linked to the exogenous DNA, but configured such that the negatively selectable marker flanks the targeting sequence, and such that a correct homologous recombination event with sequences in the host cell genome does not result in the stable integration of the negatively selectable marker. Markers useful for this purpose include the Herpes Simplex Virus thymidine kinase (TK) gene or the bacterial xanthine-guanine phosphoribosyl-transferase (gpt) gene.

The gene targeting or gene activation techniques which can be used in accordance with this aspect of the invention are more particularly described in U.S. Pat. No. 5,272,071 to Chappel; U.S. Pat. No. 5,578,461 to Sherwin et al.; International Application No. PCT/US92/09627 (WO93/09222) by Selden et al.; and International Application No. PCT/US90/06436 (WO91/06667) by Skoultchi et al., each of which is incorporated by reference herein in its entirety.

4.6 Polypeptides of the Invention

The isolated polypeptides of the invention include, but are not limited to, a polypeptide comprising: the amino acid sequences set forth as any one of SEQ ID NO: 1–441 or an amino acid sequence encoded by any one of the nucleotide sequences SEQ ID NOs: 1–441 or the corresponding full length or mature protein. Polypeptides of the invention also include polypeptides preferably with biological or immunological activity that are encoded by: (a) a polynucleotide having any one of the nucleotide sequences set forth in SEQ ID NOs: 1–441 or (b) polynucleotides encoding any one of the amino acid sequences set forth as SEQ ID NO: 1–441 or (c) polynucleotides that hybridize to the complement of the polynucleotides of either (a) or (b) under stringent hybridization conditions. The invention also provides biologically active or immunologically active variants of any of the amino acid sequences set forth as SEQ ID NO: 1–441 or the corresponding full length or mature protein; and "substantial equivalents" thereof (e.g., with at least about 65%, at least about 70%, at least about 75%, at least about 80%, at least about 85%, 86%, 87%, 88%, 89%, at least about 90%, 91%, 92%, 93%, 94%, typically at least about 95%, 96%, 97%, more typically at least about 98%, or most typically at least about 99% amino acid identity) that retain biological activity. Polypeptides encoded by allelic variants may have a similar, increased, or decreased activity compared to polypeptides comprising SEQ ID NO: 1–441.

Fragments of the proteins of the present invention which are capable of exhibiting biological activity are also encompassed by the present invention. Fragments of the protein may be in linear form or they may be cyclized using known methods, for example, as described in H. U. Saragovi, et al., Bio/Technology 10, 773–778 (1992) and in R. S. McDowell, et al., J. Amer. Chem. Soc. 114, 9245–9253 (1992), both of which are incorporated herein by reference. Such fragments may be fused to carrier molecules such as immunoglobulins for many purposes, including increasing the valency of protein binding sites.

The present invention also provides both full-length and mature forms (for example, without a signal sequence or precursor sequence) of the disclosed proteins. The protein coding sequence is identified in the sequence listing by translation of the disclosed nucleotide sequences. The mature form of such protein may be obtained by expression of a full-length polynucleotide in a suitable mammalian cell or other host cell. The sequence of the mature form of the protein is also determinable from the amino acid sequence of the full-length form. Where proteins of the present invention are membrane bound, soluble forms of the proteins are also provided. In such forms, part or all of the regions causing the proteins to be membrane bound are deleted so that the proteins are fully secreted from the cell in which they are expressed.

Protein compositions of the present invention may further comprise an acceptable carrier, such as a hydrophilic, e.g., pharmaceutically acceptable, carrier.

The present invention further provides isolated polypeptides encoded by the nucleic acid fragments of the present invention or by degenerate variants of the nucleic acid fragments of the present invention. By "degenerate variant" is intended nucleotide fragments which differ from a nucleic acid fragment of the present invention (e.g., an ORF) by nucleotide sequence but, due to the degeneracy of the genetic code, encode an identical polypeptide sequence. Preferred nucleic acid fragments of the present invention are the ORFs that encode proteins.

A variety of methodologies known in the art can be utilized to obtain any one of the isolated polypeptides or proteins of the present invention. At the simplest level, the amino acid sequence can be synthesized using commercially available peptide synthesizers. The synthetically-constructed protein sequences, by virtue of sharing primary, secondary or tertiary structural and/or conformational characteristics with proteins may possess biological properties in common therewith, including protein activity. This technique is particularly useful in producing small peptides and fragments of larger polypeptides. Fragments are useful, for example, in generating antibodies against the native polypeptide. Thus, they may be employed as biologically active or immunological substitutes for natural, purified proteins in screening of therapeutic compounds and in immunological processes for the development of antibodies.

The polypeptides and proteins of the present invention can alternatively be purified from cells which have been altered to express the desired polypeptide or protein. As used herein, a cell is said to be altered to express a desired polypeptide or protein when the cell, through genetic manipulation, is made to produce a polypeptide or protein which it normally does not produce or which the cell normally produces at a lower level. One skilled in the art can readily adapt procedures for introducing and expressing either recombinant or synthetic sequences into eukaryotic or prokaryotic cells in order to generate a cell which produces one of the polypeptides or proteins of the present invention.

The invention also relates to methods for producing a polypeptide comprising growing a culture of host cells of the invention in a suitable culture medium, and purifying the protein from the cells or the culture in which the cells are grown. For example, the methods of the invention include a process for producing a polypeptide in which a host cell containing a suitable expression vector that includes a polynucleotide of the invention is cultured under conditions that allow expression of the encoded polypeptide. The polypeptide can be recovered from the culture, conveniently from the culture medium, or from a lysate prepared from the host cells and further purified. Preferred embodiments include those in which the protein produced by such process is a full length or mature form of the protein.

In an alternative method, the polypeptide or protein is purified from bacterial cells which naturally produce the polypeptide or protein. One skilled in the art can readily follow known methods for isolating polypeptides and proteins in order to obtain one of the isolated polypeptides or proteins of the present invention. These include, but are not limited to, immunochromatography, HPLC, size-exclusion chromatography, ion-exchange chromatography, and immuno-affinity chromatography. See, e.g., Scopes, *Protein Purification: Principles and Practice*, Springer-Verlag (1994); Sambrook, et al., in Molecular Cloning: *A Laboratory Manual;* Ausubel et al., *Current Protocols in Molecular Biology.* Polypeptide fragments that retain biological/immunological activity include fragments comprising greater than about 100 amino acids, or greater than about 200 amino acids, and fragments that encode specific protein domains.

The purified polypeptides can be used in in vitro binding assays which are well known in the art to identify molecules which bind to the polypeptides. These molecules include but are not limited to, for e.g., small molecules, molecules from combinatorial libraries, antibodies or other proteins. The molecules identified in the binding assay are then tested for antagonist or agonist activity in in vivo tissue culture or animal models that are well known in the art. In brief, the molecules are titrated into a plurality of cell cultures or animals and then tested for either cell/animal death or prolonged survival of the animal/cells.

In addition, the peptides of the invention or molecules capable of binding to the peptides may be complexed with toxins, e.g., ricin or cholera, or with other compounds that are toxic to cells. The toxin-binding molecule complex is then targeted to a tumor or other cell by the specificity of the binding molecule for SEQ ID NO: 1–441.

The protein of the invention may also be expressed as a product of transgenic animals, e.g., as a component of the milk of transgenic cows, goats, pigs, or sheep which are characterized by somatic or germ cells containing a nucleotide sequence encoding the protein.

The proteins provided herein also include proteins characterized by amino acid sequences similar to those of purified proteins but into which modification are naturally provided or deliberately engineered. For example, modifications, in the peptide or DNA sequence, can be made by those skilled in the art using known techniques. Modifications of interest in the protein sequences may include the alteration, substitution, replacement, insertion or deletion of a selected amino acid residue in the coding sequence. For example, one or more of the cysteine residues may be deleted or replaced with another amino acid to alter the conformation of the molecule. Techniques for such alteration, substitution, replacement, insertion or deletion are well known to those skilled in the art (see, e.g., U.S. Pat. No. 4,518,584). Preferably, such alteration, substitution, replacement, insertion or deletion retains the desired activity of the protein. Regions of the protein that are important for the protein function can be determined by various methods known in the art including the alanine-scanning method which involved systematic substitution of single or strings of amino acids with alanine, followed by testing the resulting alanine-containing variant for biological activity. This type of analysis determines the importance of the substituted amino acid(s) in biological activity. Regions of the protein that are important for protein function may be determined by the eMATRIX program.

Other fragments and derivatives of the sequences of proteins which would be expected to retain protein activity in whole or in part and are useful for screening or other immunological methodologies may also be easily made by those skilled in the art given the disclosures herein. Such modifications are encompassed by the present invention.

The protein may also be produced by operably linking the isolated polynucleotide of the invention to suitable control sequences in one or more insect expression vectors, and employing an insect expression system. Materials and methods for baculovirus/insect cell expression systems are commercially available in kit form from, e.g., Invitrogen, San Diego, Calif., U.S.A. (the MaxBat™ kit), and such methods are well known in the art, as described in Summers and Smith, Texas Agricultural Experiment Station Bulletin No. 1555 (1987), incorporated herein by reference. As used herein, an insect cell capable of expressing a polynucleotide of the present invention is "transformed."

The protein of the invention may be prepared by culturing transformed host cells under culture conditions suitable to express the recombinant protein. The resulting expressed protein may then be purified from such culture (i.e., from culture medium or cell extracts) using known purification processes, such as gel filtration and ion exchange chromatography. The purification of the protein may also include an affinity column containing agents which will bind to the protein; one or more column steps over such affinity resins as concanavalin A-agarose, heparin-toyopearl™ or Cibacrom blue 3GA Sepharose™; one or more steps involving hydrophobic interaction chromatography using such resins as phenyl ether, butyl ether, or propyl ether; or immunoaffinity chromatography.

Alternatively, the protein of the invention may also be expressed in a form which will facilitate purification. For example, it may be expressed as a fusion protein, such as those of maltose binding protein (MBP), glutathione-S-transferase (GST) or thioredoxin (TRX), or as a His tag. Kits for expression and purification of such fusion proteins are commercially available from New England BioLab (Beverly, Mass.), Pharmacia (Piscataway, N.J.) and Invitrogen, respectively. The protein can also be tagged with an epitope and subsequently purified by using a specific antibody directed to such epitope. One such epitope ("FLAG") is commercially available from Kodak (New Haven, Conn.).

Finally, one or more reverse-phase high performance liquid chromatography (RP-HPLC) steps employing hydrophobic RP-HPLC media, e.g., silica gel having pendant methyl or other aliphatic groups, can be employed to further purify the protein. Some or all of the foregoing purification steps, in various combinations, can also be employed to provide a substantially homogeneous isolated recombinant protein. The protein thus purified is substantially free of other mammalian proteins and is defined in accordance with the present invention as an "isolated protein."

The polypeptides of the invention include analogs (variants). This embraces fragments, as well as peptides in which one or more amino acids has been deleted, inserted, or substituted. Also, analogs of the polypeptides of the invention embrace fusions of the polypeptides or modifications of the polypeptides of the invention, wherein the polypeptide or analog is fused to another moiety or moieties, e.g., targeting moiety or another therapeutic agent. Such analogs may exhibit improved properties such as activity and/or stability. Examples of moieties which may be fused to the polypeptide or an analog include, for example, targeting moieties which provide for the delivery of polypeptide to pancreatic cells, e.g., antibodies to pancreatic cells, antibodies to immune cells such as T-cells, monocytes, dendritic cells, granulocytes, etc., as well as receptor and ligands expressed on pancreatic or immune cells. Other moieties which may be fused to the polypeptide include therapeutic agents which are used for treatment, for example, immunosuppressive drugs such as cyclosporin, SK506, azathioprine, CD3 antibodies and steroids. Also, polypeptides may be fused to immune modulators, and other cytokines such as alpha or beta interferon.

4.6.1 Determining Polypeptide and Polynucleotide Identity and Similarity

Preferred identity and/or similarity are designed to give the largest match between the sequences tested. Methods to determine identity and similarity are codified in computer programs including, but are not limited to, the GCG program package, including GAP (Devereux, J., et al., Nucleic Acids Research 12(1):387 (1984); Genetics Computer Group, University of Wisconsin, Madison, Wis.), BLASTP, BLASTN, BLASTX, FASTA (Altschul, S. F. et al., J. Molec. Biol. 215:403–410 (1990), PSI-BLAST (Altschul S. F. et al., Nucleic Acids Res. vol. 25, pp. 3389–3402, herein incorporated by reference), eMatrix software (Wu et al., J. Comp. Biol., Vol. 6, pp. 219–235 (1999), herein incorporated by reference), eMotif software (Nevill-Manning et al, ISMB-97, Vol. 4, pp. 202–209, herein incorporated by reference), pFam software (Sonnhammer et al., Nucleic Acids Res., Vol. 26(1), pp. 320–322 (1998), herein incorporated by reference) and the Kyte-Doolittle hydrophobocity prediction algorithm (J. Mol Biol, 157, pp. 105–31 (1982), incorporated herein by reference). The BLAST programs are publicly available from the National Center for Biotechnology Information (NCBI) and other sources (BLAST Manual, Altschul, S., et al. NCB NLM NIH Bethesda, Md. 20894; Altschul, S., et al., J. Mol. Biol. 215:403–410 (1990).

4.7 Chimeric and Fusion Proteins

The invention also provides chimeric or fusion proteins. As used herein, a "chimeric protein" or "fusion protein" comprises a polypeptide of the invention operatively linked to another polypeptide. Within a fusion protein the polypeptide according to the invention can correspond to all or a portion of a protein according to the invention. In one embodiment, a fusion protein comprises at least one biologically active portion of a protein according to the invention. In another embodiment, a fusion protein comprises at least two biologically active portions of a protein according to the invention. Within the fusion protein, the term "operatively linked" is intended to indicate that the polypeptide according to the invention and the other polypeptide are fused in-frame to each other. The polypeptide can be fused to the N-terminus or C-terminus, or to the middle.

For example, in one embodiment a fusion protein comprises a polypeptide according to the invention operably linked to the extracellular domain of a second protein.

In another embodiment, the fusion protein is a GST-fusion protein in which the polypeptide sequences of the invention are fused to the C-terminus of the GST (i.e., glutathione S-transferase) sequences.

In another embodiment, the fusion protein is an immunoglobulin fusion protein in which the polypeptide sequences according to the invention comprise one or more domains fused to sequences derived from a member of the immunoglobulin protein family. The immunoglobulin fusion proteins of the invention can be incorporated into pharmaceutical compositions and administered to a subject to inhibit an interaction between a ligand and a protein of the invention on the surface of a cell, to thereby suppress signal transduction in vivo. The immunoglobulin fusion proteins can be used to affect the bioavailability of a cognate ligand. Inhibition of the ligand/protein interaction may be useful therapeutically for both the treatment of proliferative and differentiative disorders, e.g., cancer as well as modulating (e.g., promoting or inhibiting) cell survival. Moreover, the immunoglobulin fusion proteins of the invention can be used as immunogens to produce antibodies in a subject, to purify ligands, and in screening assays to identify molecules that inhibit the interaction of a polypeptide of the invention with a ligand.

A chimeric or fusion protein of the invention can be produced by standard recombinant DNA techniques. For example, DNA fragments coding for the different polypeptide sequences are ligated together in-frame in accordance with conventional techniques, e.g., by employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. In another embodiment, the fusion gene can be synthesized by conventional techniques including automated DNA synthesizers. Alternatively, PCR amplification of gene fragments can be carried out using anchor primers that give rise to complementary overhangs between two consecutive gene fragments that can subsequently be annealed and reamplified to generate a chimeric gene sequence (see, for example, Ausubel et al. (eds.) CURRENT PROTOCOLS IN MOLECULAR BIOLOGY, John Wiley & Sons, 1992). Moreover, many expression vectors are commercially available that already encode a fuision moiety (e.g., a GST polypeptide). A nucleic acid encoding a polypeptide of the invention can be cloned into such an expression vector such that the fusion moiety is linked in-frame to the protein of the invention.

4.8 Gene Therapy

Mutations in the polynucleotides of the invention gene may result in loss of normal function of the encoded protein. The invention thus provides gene therapy to restore normal activity of the polypeptides of the invention; or to treat disease states involving polypeptides of the invention. Delivery of a functional gene encoding polypeptides of the invention to appropriate cells is effected ex vivo, in situ, or in vivo by use of vectors, and more particularly viral vectors (e.g., adenovirus, adeno-associated virus, or a retrovirus), or ex vivo by use of physical DNA transfer methods (e.g., liposomes or chemical treatments). See, for example, Anderson, Nature, supplement to vol. 392, no. 6679, pp. 25–20 (1998). For additional reviews of gene therapy technology see Friedmann, Science, 244: 1275–1281 (1989); Verma, Scientific American: 68–84 (1990); and Miller, Nature, 357: 455–460 (1992). Introduction of any one of the nucleotides of the present invention or a gene encoding the polypeptides of the present invention can also be accomplished with extrachromosomal substrates (transient expression) or artificial chromosomes (stable expression). Cells may also be cultured ex vivo in the presence of proteins of the present invention in order to proliferate or to produce a desired effect on or activity in such cells. Treated cells can then be introduced in vivo for therapeutic purposes. Alternatively, it is contemplated that in other human disease states, preventing the expression of or inhibiting the activity of polypeptides of the invention will be useful in treating the disease states. It is contemplated that antisense therapy or gene therapy could be applied to negatively regulate the expression of polypeptides of the invention.

Other methods inhibiting expression of a protein include the introduction of antisense molecules to the nucleic acids of the present invention, their complements, or their translated RNA sequences, by methods known in the art. Further, the polypeptides of the present invention can be inhibited by using targeted deletion methods, or the insertion of a negative regulatory element such as a silencer, which is tissue specific.

The present invention still further provides cells genetically engineered in vivo to express the polynucleotides of the invention, wherein such polynucleotides are in operative association with a regulatory sequence heterologous to the host cell which drives expression of the polynucleotides in the cell. These methods can be used to increase or decrease the expression of the polynucleotides of the present invention.

Knowledge of DNA sequences provided by the invention allows for modification of cells to permit, increase, or decrease, expression of endogenous polypeptide. Cells can be modified (e.g., by homologous recombination) to provide increased polypeptide expression by replacing, in whole or in part, the naturally occurring promoter with all or part of a heterologous promoter so that the cells express the protein at higher levels. The heterologous promoter is inserted in such a manner that it is operatively linked to the desired protein encoding sequences. See, for example, PCT International Publication No. WO 94/12650, PCT International Publication No. WO 92/20808, and PCT International Publication No. WO 91/09955. It is also contemplated that, in addition to heterologous promoter DNA, amplifiable marker DNA (e.g., ada, dhfr, and the multifunctional CAD gene which encodes carbamyl phosphate synthase, aspartate transcarbamylase, and dihydroorotase) and/or intron DNA may be inserted along with the heterologous promoter DNA. If linked to the desired protein coding sequence, amplification of the marker DNA by standard selection methods results in co-amplification of the desired protein coding sequences in the cells.

In another embodiment of the present invention, cells and tissues may be engineered to express an endogenous gene comprising the polynucleotides of the invention under the control of inducible regulatory elements, in which case the regulatory sequences of the endogenous gene may be replaced by homologous recombination. As described herein, gene targeting can be used to replace a gene's existing regulatory region with a regulatory sequence isolated from a different gene or a novel regulatory sequence synthesized by genetic engineering methods. Such regulatory sequences may be comprised of promoters, enhancers, scaffold-attachment regions, negative regulatory elements, transcriptional initiation sites, regulatory protein binding sites or combinations of said sequences. Alternatively, sequences which affect the structure or stability of the RNA or protein produced may be replaced, removed, added, or otherwise modified by targeting. These sequences include polyadenylation signals, mRNA stability elements, splice sites, leader sequences for enhancing or modifying transport or secretion properties of the protein, or other sequences which alter or improve the function or stability of protein or RNA molecules.

The targeting event may be a simple insertion of the regulatory sequence, placing the gene under the control of the new regulatory sequence, e.g., inserting a new promoter or enhancer or both upstream of a gene. Alternatively, the targeting event may be a simple deletion of a regulatory element, such as the deletion of a tissue-specific negative regulatory element. Alternatively, the targeting event may replace an existing element; for example, a tissue-specific enhancer can be replaced by an enhancer that has broader or different cell-type specificity than the naturally occurring elements. Here, the naturally occurring sequences are deleted and new sequences are added. In all cases, the identification of the targeting event may be facilitated by the use of one or more selectable marker genes that are contiguous with the targeting DNA, allowing for the selection of cells in which the exogenous DNA has integrated into the cell genome. The identification of the targeting event may also be facilitated by the use of one or more marker genes exhibiting the property of negative selection, such that the negatively selectable marker is linked to the exogenous DNA, but configured such that the negatively selectable marker flanks the targeting sequence, and such that a correct homologous recombination event with sequences in the host cell genome does not result in the stable integration of the negatively selectable marker. Markers useful for this purpose include the Herpes Simplex Virus thymidine kinase (TK) gene or the bacterial xanthine-guanine phosphoribosyl-transferase (gpt) gene.

The gene targeting or gene activation techniques which can be used in accordance with this aspect of the invention are more particularly described in U.S. Pat. No. 5,272,071 to Chappel; U.S. Pat. No. 5,578,461 to Sherwin et al.; International Application No. PCT/US92/09627 (WO93/09222) by Selden et al.; and International Application No. PCT/US90/06436 (WO91/06667) by Skoultchi et al., each of which is incorporated by reference herein in its entirety.

4.9 Transgenic Animals

In preferred methods to determine biological functions of the polypeptides of the invention in vivo, one or more genes provided by the invention are either over expressed or inactivated in the germ line of animals using homologous recombination [Capecchi, Science 244:1288–1292 (1989)]. Animals in which the gene is over expressed, under the regulatory control of exogenous or endogenous promoter elements, are known as transgenic animals. Animals in which an endogenous gene has been inactivated by homologous recombination are referred to as "knockout" animals. Knockout animals, preferably non-human mammals, can be prepared as described in U.S. Pat. No. 5,557,032, incorporated herein by reference. Transgenic animals are useful to determine the roles polypeptides of the invention play in biological processes, and preferably in disease states. Transgenic animals are useful as model systems to identify compounds that modulate lipid metabolism. Transgenic animals, preferably non-human mammals, are produced using methods as described in U.S. Pat. No 5,489,743 and PCT Publication No. WO94/28122, incorporated herein by reference.

Transgenic animals can be prepared wherein all or part of a promoter of the polynucleotides of the invention is either activated or inactivated to alter the level of expression of the polypeptides of the invention. Inactivation can be carried out using homologous recombination methods described above. Activation can be achieved by supplementing or even replacing the homologous promoter to provide for increased protein expression. The homologous promoter can be supplemented by insertion of one or more heterologous enhancer elements known to confer promoter activation in a particular tissue.

The polynucleotides of the present invention also make possible the development, through, e.g., homologous recombination or knock out strategies, of animals that fail to express polypeptides of the invention or that express a variant polypeptide. Such animals are useful as models for studying the in vivo activities of polypeptide as well as for studying modulators of the polypeptides of the invention.

In preferred methods to determine biological functions of the polypeptides of the invention in vivo, one or more genes provided by the invention are either over expressed or inactivated in the germ line of animals using homologous recombination [Capecchi, Science 244:1288–1292 (1989)]. Animals in which the gene is over expressed, under the regulatory control of exogenous or endogenous promoter elements, are known as transgenic animals. Animals in which an endogenous gene has been inactivated by homologous recombination are referred to as "knockout" animals. Knockout animals, preferably non-human mammals, can be prepared as described in U.S. Pat. No. 5,557,032, incorporated herein by reference. Transgenic animals are useful to determine the roles polypeptides of the invention play in biological processes, and preferably in disease states. Transgenic animals are useful as model systems to identify compounds that modulate lipid metabolism. Transgenic animals, preferably non-human mammals, are produced using methods as described in U.S. Pat. No 5,489,743 and PCT Publication No. WO94/28122, incorporated herein by reference.

Transgenic animals can be prepared wherein all or part of the polynucleotides of the invention promoter is either activated or inactivated to alter the level of expression of the polypeptides of the invention. Inactivation can be carried out using homologous recombination methods described above. Activation can be achieved by supplementing or even replacing the homologous promoter to provide for increased protein expression. The homologous promoter can be supplemented by insertion of one or more heterologous enhancer elements known to confer promoter activation in a particular tissue.

4.10 Uses and Biological Activity

The polynucleotides and proteins of the present invention are expected to exhibit one or more of the uses or biological activities (including those associated with assays cited herein) identified herein. Uses or activities described for proteins of the present invention may be provided by administration or use of such proteins or of polynucleotides encoding such proteins (such as, for example, in gene therapies or vectors suitable for introduction of DNA). The mechanism underlying the particular condition or pathology will dictate whether the polypeptides of the invention, the polynucleotides of the invention or modulators (activators or inhibitors) thereof would be beneficial to the subject in need of treatment. Thus, "therapeutic compositions of the invention" include compositions comprising isolated polynucleotides (including recombinant DNA molecules, cloned genes and degenerate variants thereof) or polypeptides of the invention (including full length protein, mature protein and truncations or domains thereof), or compounds and other substances that modulate the overall activity of the target gene products, either at the level of target gene/protein expression or target protein activity. Such modulators include polypeptides, analogs, (variants), including fragments and fusion proteins, antibodies and other binding proteins; chemical compounds that directly or indirectly activate or inhibit the polypeptides of the invention (identified, e.g., via drug screening assays as described herein); antisense polynucleotides and polynucleotides suitable for triple helix formation; and in particular antibodies or other binding partners that specifically recognize one or more epitopes of the polypeptides of the invention.

The polypeptides of the present invention may likewise be involved in cellular activation or in one of the other physiological pathways described herein.

4.10.1 Research uses and Utilities

The polynucleotides provided by the present invention can be used by the research community for various purposes. The polynucleotides can be used to express recombinant protein for analysis, characterization or therapeutic use; as markers for tissues in which the corresponding protein is preferentially expressed (either constitutively or at a particular stage of tissue differentiation or development or in disease states); as molecular weight markers on gels; as chromosome markers or tags (when labeled) to identify chromosomes or to map related gene positions; to compare with endogenous DNA sequences in patients to identify potential genetic disorders; as probes to hybridize and thus discover novel, related DNA sequences; as a source of information to derive PCR primers for genetic fingerprinting; as a probe to "subtract-out" known sequences in the process of discovering other novel polynucleotides; for selecting and making oligomers for attachment to a "gene chip" or other support, including for examination of expression patterns; to raise anti-protein antibodies using DNA immunization techniques; and as an antigen to raise anti-DNA antibodies or elicit another immune response. Where the polynucleotide encodes a protein which binds or potentially binds to another protein (such as, for example, in a receptor-ligand interaction), the polynucleotide can also be used in interaction trap assays (such as, for example, that described in Gyuris et al., Cell 75:791–803 (1993)) to identify polynucleotides encoding the other protein with which binding occurs or to identify inhibitors of the binding interaction.

The polypeptides provided by the present invention can similarly be used in assays to determine biological activity, including in a panel of multiple proteins for high-throughput screening; to raise antibodies or to elicit another immune response; as a reagent (including the labeled reagent) in assays designed to quantitatively determine levels of the protein (or its receptor) in biological fluids; as markers for tissues in which the corresponding polypeptide is preferentially expressed (either constitutively or at a particular stage of tissue differentiation or development or in a disease state); and, of course, to isolate correlative receptors or ligands. Proteins involved in these binding interactions can also be used to screen for peptide or small molecule inhibitors or agonists of the binding interaction.

Any or all of these research utilities are capable of being developed into reagent grade or kit format for commercialization as research products.

Methods for performing the uses listed above are well known to those skilled in the art. References disclosing such methods include without limitation "Molecular Cloning: A Laboratory Manual", 2d ed., Cold Spring Harbor Laboratory Press, Sambrook, J., E. F. Fritsch and T. Maniatis eds., 1989, and "Methods in Enzymology: Guide to Molecular Cloning Techniques", Academic Press, Berger, S. L. and A. R. Kimmel eds., 1987.

4.10.2 Nutritional Uses

Polynucleotides and polypeptides of the present invention can also be used as nutritional sources or supplements. Such uses include without limitation use as a protein or amino acid supplement, use as a carbon source, use as a nitrogen source and use as a source of carbohydrate. In such cases the polypeptide or polynucleotide of the invention can be added to the feed of a particular organism or can be administered as a separate solid or liquid preparation, such as in the form of powder, pills, solutions, suspensions or capsules. In the case of microorganisms, the polypeptide or polynucleotide of the invention can be added to the medium in or on which the microorganism is cultured.

4.10.3 Cytokine and Cell Proliferation/Differentiation Activity

A polypeptide of the present invention may exhibit activity relating to cytokine, cell proliferation (either inducing or inhibiting) or cell differentiation (either inducing or inhibiting) activity or may induce production of other cytokines in certain cell populations. A polynucleotide of the invention can encode a polypeptide exhibiting such attributes. Many protein factors discovered to date, including all known cytokines, have exhibited activity in one or more factor-dependent cell proliferation assays, and hence the assays serve as a convenient confirmation of cytokine activity. The activity of therapeutic compositions of the present invention is evidenced by any one of a number of routine factor dependent cell proliferation assays for cell lines including, without limitation, 32D, DA2, DA1G, T10, B9, B9/11, BaF3, MC9/G, M+(preB M+), 2E8, RB5, DA1, 123, T1165, HT2, CTLL2, TF-1, Mo7e, CMK, HUVEC, and Caco. Therapeutic compositions of the invention can be used in the following:

Assays for T-cell or thymocyte proliferation include without limitation those described in: Current Protocols in Immunology, Ed by J. E. Coligan, A. M. Kruisbeek, D. H. Margulies, E. M. Shevach, W. Strober, Pub. Greene Publishing Associates and Wiley-Interscience (Chapter 3, In Vitro assays for Mouse Lymphocyte Function 3.1–3.19; Chapter 7, Immunologic studies in Humans); Takai et al., J. Immunol. 137:3494–3500, 1986; Bertagnolli et al., J. Immunol. 145:1706–1712, 1990; Bertagnolli et al., Cellular Immunology 133:327–341, 1991; Bertagnolli, et al., I. Immunol. 149:3778–3783, 1992; Bowman et al., I. Immunol. 152:1756–1761, 1994.

Assays for cytokine production and/or proliferation of spleen cells, lymph node cells or thymocytes include, without limitation, those described in: Polyclonal T cell stimulation, Kruisbeek, A. M. and Shevach, E. M. In Current Protocols in Immunology. J. E. e.a. Coligan eds. Vol 1 pp. 3.12.1–3.12.14, John Wiley and Sons, Toronto. 1994; and Measurement of mouse and human interleukin-γ, Schreiber, R. D. In Current Protocols in Immunology. J. E. e.a. Coligan eds. Vol 1 pp. 6.8.1–6.8.8, John Wiley and Sons, Toronto. 1994.

Assays for proliferation and differentiation of hematopoietic and lymphopoietic cells include, without limitation, those described in: Measurement of Human and Murine Interleukin 2 and Interleukin 4, Bottomly, K., Davis, L. S. and Lipsky, P. E. In Current Protocols in Immunology. J. E. e.a. Coligan eds. Vol 1 pp. 6.3.1–6.3.12, John Wiley and Sons, Toronto. 1991; deVries et al., J. Exp. Med.

173:1205–1211, 1991; Moreau et al., Nature 336:690–692, 1988; Greenberger et al., Proc. Natl. Acad. Sci. U.S.A. 80:2931–2938, 1983; Measurement of mouse and human interleukin 6—Nordan, R. In Current Protocols in Immunology. J. E. Coligan eds. Vol 1 pp. 6.6.1–6.6.5, John Wiley and Sons, Toronto. 1991; Smith et al., Proc. Natl. Aced. Sci. U.S.A. 83:1857–1861, 1986; Measurement of human Interleukin 11—Bennett, F., Giannotti, J., Clark, S. C. and Turner, K. J. In Current Protocols in Immunology. J. E. Coligan eds. Vol 1 pp. 6.15.1 John Wiley and Sons, Toronto. 1991; Measurement of mouse and human Interleukin 9—Ciarletta, A., Giannotti, J., Clark, S. C. and Turner, K. J. In Current Protocols in Immunology. J. E. Coligan eds. Vol 1 pp. 6.13.1, John Wiley and Sons, Toronto. 1991.

Assays for T-cell clone responses to antigens (which will identify, among others, proteins that affect APC-T cell interactions as well as direct T-cell effects by measuring proliferation and cytokine production) include, without limitation, those described in: Current Protocols in Immunology, Ed by J. E. Coligan, A. M. Kruisbeek, D. H. Margulies, E. M. Shevach, W Strober, Pub. Greene Publishing Associates and Wiley-Interscience (Chapter 3, In Vitro assays for Mouse Lymphocyte Function; Chapter 6, Cytokines and their cellular receptors; Chapter 7, Immunologic studies in Humans); Weinberger et al., Proc. Natl. Acad. Sci. USA 77:6091–6095, 1980; Weinberger et al., Eur. J. Immun. 11:405–411, 1981; Takai et al., J. Immunol. 137:3494–3500, 1986; Takai et al., J. Immunol. 140:508–512, 1988.

4.10.4 Stem Cell Growth Factor Activity

A polypeptide of the present invention may exhibit stem cell growth factor activity and be involved in the proliferation, differentiation and survival of pluripotent and totipotent stem cells including primordial germ cells, embryonic stem cells, hematopoietic stem cells and/or germ line stem cells. Administration of the polypeptide of the invention to stem cells in vivo or ex vivo is expected to maintain and expand cell populations in a totipotential or pluripotential state which would be useful for re-engineering damaged or diseased tissues, transplantation, manufacture of bio-pharmaceuticals and the development of bio-sensors. The ability to produce large quantities of human cells has important working applications for the production of human proteins which currently must be obtained from non-human sources or donors, implantation of cells to treat diseases such as Parkinson's, Alzheimer's and other neurodegenerative diseases; tissues for grafting such as bone marrow, skin, cartilage, tendons, bone, muscle (including cardiac muscle), blood vessels, cornea, neural cells, gastrointestinal cells and others; and organs for transplantation such as kidney, liver, pancreas (including islet cells), heart and lung.

It is contemplated that multiple different exogenous growth factors and/or cytokines may be administered in combination with the polypeptide of the invention to achieve the desired effect, including any of the growth factors listed herein, other stem cell maintenance factors, and specifically including stem cell factor (SCF), leukemia inhibitory factor (LIF), Flt-3 ligand (Flt-3L), any of the interleukins, recombinant soluble IL-6 receptor fused to IL-6, macrophage inflammatory protein 1-alpha (MIP-1-alpha), G-CSF, GM-CSF, thrombopoietin (TPO), platelet factor 4 (PF-4), platelet-derived growth factor (PDGF), neural growth factors and basic fibroblast growth factor (bFGF).

Since totipotent stem cells can give rise to virtually any mature cell type, expansion of these cells in culture will facilitate the production of large quantities of mature cells. Techniques for culturing stem cells are known in the art and administration of polypeptides of the invention, optionally with other growth factors and/or cytokines, is expected to enhance the survival and proliferation of the stem cell populations. This can be accomplished by direct administration of the polypeptide of the invention to the culture medium. Alternatively, stroma cells transfected with a polynucleotide that encodes for the polypeptide of the invention can be used as a feeder layer for the stem cell populations in culture or in vivo. Stromal support cells for feeder layers may include embryonic bone marrow fibroblasts, bone marrow stromal cells, fetal liver cells, or cultured embryonic fibroblasts (see U.S. Pat. No. 5,690,926).

Stem cells themselves can be transfected with a polynucleotide of the invention to induce autocrine expression of the polypeptide of the invention. This will allow for generation of undifferentiated totipotential/pluripotential stem cell lines that are useful as is or that can then be differentiated into the desired mature cell types. These stable cell lines can also serve as a source of undifferentiated totipotential/pluripotential mRNA to create cDNA libraries and templates for polymerase chain reaction experiments. These studies would allow for the isolation and identification of differentially expressed genes in stem cell populations that regulate stem cell proliferation and/or maintenance.

Expansion and maintenance of totipotent stem cell populations will be useful in the treatment of many pathological conditions. For example, polypeptides of the present invention may be used to manipulate stem cells in culture to give rise to neuroepithelial cells that can be used to augment or replace cells damaged by illness, autoimmune disease, accidental damage or genetic disorders. The polypeptide of the invention may be usefull for inducing the proliferation of neural cells and for the regeneration of nerve and brain tissue, i.e. for the treatment of central and peripheral nervous system diseases and neuropathies, as well as mechanical and traumatic disorders which involve degeneration, death or trauma to neural cells or nerve tissue. In addition, the expanded stem cell populations can also be genetically altered for gene therapy purposes and to decrease host rejection of replacement tissues after grafting or implantation.

Expression of the polypeptide of the invention and its effect on stem cells can also be manipulated to achieve controlled differentiation of the stem cells into more differentiated cell types. A broadly applicable method of obtaining pure populations of a specific differentiated cell type from undifferentiated stem cell populations involves the use of a cell-type specific promoter driving a selectable marker. The selectable marker allows only cells of the desired type to survive. For example, stem cells can be induced to differentiate into cardiomyocytes (Wobus et al., Differentiation, 48: 173–182, (1991); Klug et al., J. Clin. Invest., 98(1): 216–224, (1998)) or skeletal muscle cells (Browder, L. W. In: *Principles of Tissue Engineering eds.* Lanza et al., Academic Press (1997)). Alternatively, directed differentiation of stem cells can be accomplished by culturing the stem cells in the presence of a differentiation factor such as retinoic acid and an antagonist of the polypeptide of the invention which would inhibit the effects of endogenous stem cell factor activity and allow differentiation to proceed.

In vitro cultures of stem cells can be used to determine if the polypeptide of the invention exhibits stem cell growth factor activity. Stem cells are isolated from any one of various cell sources (including hematopoietic stem cells and embryonic stem cells) and cultured on a feeder layer, as described by Thompson et al. Proc. Natl. Acad. Sci, U.S.A., 92: 7844–7848 (1995), in the presence of the polypeptide of the invention alone or in combination with other growth factors or cytokines. The ability of the polypeptide of the invention to induce stem cells proliferation is determined by colony formation on semi-solid support e.g. as described by Bernstein et al., Blood, 77: 2316–2321 (1991).

4.10.5 Hematopoiesis Regulating Activity

A polypeptide of the present invention may be involved in regulation of hematopoiesis and, consequently, in the treatment of myeloid or lymphoid cell disorders. Even marginal biological activity in support of colony forming cells or of factor-dependent cell lines indicates involvement in regulating hematopoiesis, e.g. in supporting the growth and proliferation of erythroid progenitor cells alone or in combination with other cytokines, thereby indicating utility, for example, in treating various anemias or for use in conjunction with irradiation/chemotherapy to stimulate the production of erythroid precursors and/or erythroid cells; in supporting the growth and proliferation of myeloid cells such as granulocytes and monocytes/macrophages (i.e., traditional CSF activity) useful, for example, in conjunction with chemotherapy to prevent or treat consequent myelosuppression; in supporting the growth and proliferation of megakaryocytes and consequently of platelets thereby allowing prevention or treatment of various platelet disorders such as thrombocytopenia, and generally for use in place of or complimentary to platelet transfusions; and/or in supporting the growth and proliferation of hematopoietic stem cells which are capable of maturing to any and all of the above-mentioned hematopoietic cells and therefore find therapeutic utility in various stem cell disorders (such as those usually treated with transplantation, including, without limitation, aplastic anemia and paroxysmal nocturnal hemoglobinuria), as well as in repopulating the stem cell compartment post irradiation/chemotherapy, either in-vivo or ex-vivo (i.e., in conjunction with bone marrow transplantation or with peripheral progenitor cell transplantation (homologous or heterologous)) as normal cells or genetically manipulated for gene therapy.

Therapeutic compositions of the invention can be used in the following:

Suitable assays for proliferation and differentiation of various hematopoietic lines are cited above.

Assays for embryonic stem cell differentiation (which will identify, among others, proteins that influence embryonic differentiation hematopoiesis) include, without limitation, those described in: Johansson et al. Cellular Biology 15:141–151, 1995; Keller et al., Molecular and Cellular Biology 13:473–486, 1993; McClanahan et al., Blood 81:2903–2915, 1993.

Assays for stem cell survival and differentiation (which will identify, among others, proteins that regulate lymphohematopoiesis) include, without limitation, those described in: Methylcellulose colony forming assays, Freshney, M. G. In Culture of Hematopoietic Cells. R. I. Freshney, et al. eds. Vol pp. 265–268, Wiley-Liss, Inc., New York, N.Y. 1994; Hirayama et al., Proc. Natl. Acad. Sci. USA 89:5907–5911, 1992; Primitive hematopoietic colony forming cells with high proliferative potential, McNiece, I. K. and Briddell, R. A. In Culture of Hematopoietic Cells. R. I. Freshney, et al. eds. Vol pp. 23–39, Wiley-Liss, Inc., New York, N.Y. 1994; Neben et al., Experimental Hematology 22:353–359, 1994; Cobblestone area forming cell assay, Ploemacher, R. E. In Culture of Hematopoietic Cells. R. I. Freshney, et al. eds. Vol pp. 1–21, Wiley-Liss, Inc., New York, N.Y. 1994; Long term bone marrow cultures in the presence of stromal cells, Spooncer, E., Dexter, M. and Allen, T. In Culture of Hematopoietic Cells. R. I. Freshney, et al. eds. Vol pp. 163–179, Wiley-Liss, Inc., New York, N.Y. 1994; Long term culture initiating cell assay, Sutherland, H. J. In Culture of Hematopoietic Cells. R. I. Freshney, et al. eds. Vol pp. 139–162, Wiley-Liss, Inc., New York, N.Y. 1994.

4.10.6 Tissue Growth Activity

A polypeptide of the present invention also may be involved in bone, cartilage, tendon, ligament and/or nerve tissue growth or regeneration, as well as in wound healing and tissue repair and replacement, and in healing of burns, incisions and ulcers.

A polypeptide of the present invention which induces cartilage and/or bone growth in circumstances where bone is not normally formed, has application in the healing of bone fractures and cartilage damage or defects in humans and other animals. Compositions of a polypeptide, antibody, binding partner, or other modulator of the invention may have prophylactic use in closed as well as open fracture reduction and also in the improved fixation of artificial joints. De novo bone formation induced by an osteogenic agent contributes to the repair of congenital, trauma induced, or oncologic resection induced craniofacial defects, and also is useful in cosmetic plastic surgery.

A polypeptide of this invention may also be involved in attracting bone-forming cells, stimulating growth of bone-forming cells, or inducing differentiation of progenitors of bone-forming cells. Treatment of osteoporosis, osteoarthritis, bone degenerative disorders, or periodontal disease, such as through stimulation of bone and/or cartilage repair or by blocking inflammation or processes of tissue destruction (collagenase activity, osteoclast activity, etc.) mediated by inflammatory processes may also be possible using the composition of the invention.

Another category of tissue regeneration activity that may involve the polypeptide of the present invention is tendon/ligament formation. Induction of tendon/ligament-like tissue or other tissue formation in circumstances where such tissue is not normally formed, has application in the healing of tendon or ligament tears, deformities and other tendon or ligament defects in humans and other animals. Such a preparation employing a tendon/ligament-like tissue inducing protein may have prophylactic use in preventing damage to tendon or ligament tissue, as well as use in the improved fixation of tendon or ligament to bone or other tissues, and in repairing defects to tendon or ligament tissue. De novo tendon/ligament-like tissue formation induced by a composition of the present invention contributes to the repair of congenital, trauma induced, or other tendon or ligament defects of other origin, and is also useful in cosmetic plastic surgery for attachment or repair of tendons or ligaments. The compositions of the present invention may provide environment to attract tendon- or ligament-forming cells, stimulate growth of tendon- or ligament-forming cells, induce differentiation of progenitors of tendon- or ligament-forming cells, or induce growth of tendon/ligament cells or progenitors ex vivo for return in vivo to effect tissue repair. The compositions of the invention may also be useful in the treatment of tendinitis, carpal tunnel syndrome and other tendon or ligament defects. The compositions may also include an appropriate matrix and/or sequestering agent as a carrier as is well known in the art.

The compositions of the present invention may also be useful for proliferation of neural cells and for regeneration of nerve and brain tissue, i.e. for the treatment of central and peripheral nervous system diseases and neuropathies, as well as mechanical and traumatic disorders, which involve degeneration, death or trauma to neural cells or nerve tissue. More specifically, a composition may be used in the treatment of diseases of the peripheral nervous system, such as peripheral nerve injuries, peripheral neuropathy and localized neuropathies, and central nervous system diseases, such as Alzheimer's, Parkinson's disease, Huntington's disease, amyotrophic lateral sclerosis, and Shy-Drager syndrome. Further conditions which may be treated in accordance with the present invention include mechanical and traumatic disorders, such as spinal cord disorders, head trauma and cerebrovascular diseases such as stroke. Peripheral neuropathies resulting from chemotherapy or other medical therapies may also be treatable using a composition of the invention.

Compositions of the invention may also be useful to promote better or faster closure of non-healing wounds, including without limitation pressure ulcers, ulcers associated with vascular insufficiency, surgical and traumatic wounds, and the like.

Compositions of the present invention may also be involved in the generation or regeneration of other tissues, such as organs (including, for example, pancreas, liver, intestine, kidney, skin, endothelium), muscle (smooth, skeletal or cardiac) and vascular (including vascular endothelium) tissue, or for promoting the growth of cells comprising such tissues. Part of the desired effects may be by inhibition or modulation of fibrotic scarring may allow normal tissue to regenerate. A polypeptide of the present invention may also exhibit angiogenic activity.

A composition of the present invention may also be useful for gut protection or regeneration and treatment of lung or liver fibrosis, reperfusion injury in various tissues, and conditions resulting from systemic cytokine damage.

A composition of the present invention may also be useful for promoting or inhibiting differentiation of tissues described above from precursor tissues or cells; or for inhibiting the growth of tissues described above.

Therapeutic compositions of the invention can be used in the following:

Assays for tissue generation activity include, without limitation, those described in: International Patent Publication No. WO95/16035 (bone, cartilage, tendon); International Patent Publication No. WO95/05846 (nerve, neuronal); International Patent Publication No. WO91/07491 (skin, endothelium).

Assays for wound healing activity include, without limitation, those described in: Winter, Epidermal Wound Healing, pps. 71–112 (Maibach, H. I. and Rovee, D. T., eds.), Year Book Medical Publishers, Inc., Chicago, as modified by Eaglstein and Mertz, J. Invest. Dermatol 71:382–84 (1978).

4.10.7 Immune Stimulating or Suppressing Activity

A polypeptide of the present invention may also exhibit immune stimulating or immune suppressing activity, including without limitation the activities for which assays are described herein. A polynucleotide of the invention can encode a polypeptide exhibiting such activities. A protein may be useful in the treatment of various immune deficiencies and disorders (including severe combined immunodeficiency (SCID)), e.g., in regulating (up or down) growth and proliferation of T and/or B lymphocytes, as well as effecting the cytolytic activity of NK cells and other cell populations. These immune deficiencies may be genetic or be caused by viral (e.g., HIV) as well as bacterial or fungal infections, or may result from autoimmune disorders. More specifically, infectious diseases causes by viral, bacterial, fungal or other infection may be treatable using a protein of the present invention, including infections by HIV, hepatitis viruses, herpes viruses, mycobacteria, *Leishmania* spp., *malaria* spp. and various fungal infections such as candidiasis. Of course, in this regard, proteins of the present invention may also be useful where a boost to the immune system generally may be desirable, i.e., in the treatment of cancer.

Autoimmune disorders which may be treated using a protein of the present invention include, for example, connective tissue disease, multiple sclerosis, systemic lupus erythematosus, rheumatoid arthritis, autoimmune pulmonary inflammation, Guillain-Barre syndrome, autoimmune thyroiditis, insulin dependent diabetes mellitus, myasthenia gravis, graft-versus-host disease and autoimmune inflammatory eye disease. Such a protein (or antagonists thereof, including antibodies) of the present invention may also to be useful in the treatment of allergic reactions and conditions (e.g., anaphylaxis, serum sickness, drug reactions, food allergies, insect venom allergies, mastocytosis, allergic rhinitis, hypersensitivity pneumonitis, urticaria, angioedema, eczema, atopic dermatitis, allergic contact dermatitis, erythema multiforme, Stevens-Johnson syndrome, allergic conjunctivitis, atopic keratoconjunctivitis, venereal keratoconjunctivitis, giant papillary conjunctivitis and contact allergies), such as asthma (particularly allergic asthma) or other respiratory problems. Other conditions, in which immune suppression is desired (including, for example, organ transplantation), may also be treatable using a protein (or antagonists thereof) of the present invention. The therapeutic effects of the polypeptides or antagonists thereof on allergic reactions can be evaluated by in vivo animals models such as the cumulative contact enhancement test (Lastbom et al., Toxicology 125: 59–66, 1998), skin prick test (Hoffmann et al., Allergy 54: 446–54, 1999), guinea pig skin sensitization test (Vohr et al., Arch. Toxocol. 73: 501–9), and murine local lymph node assay (Kimber et al., J. Toxicol. Environ. Health 53: 563–79).

Using the proteins of the invention it may also be possible to modulate immune responses, in a number of ways. Down regulation may be in the form of inhibiting or blocking an immune response already in progress or may involve preventing the induction of an immune response. The functions of activated T cells may be inhibited by suppressing T cell responses or by inducing specific tolerance in T cells, or both. Immunosuppression of T cell responses is generally an active, non-antigen-specific, process which requires continuous exposure of the T cells to the suppressive agent. Tolerance, which involves inducing non-responsiveness or anergy in T cells, is distinguishable from immunosuppression in that it is generally antigen-specific and persists after exposure to the tolerizing agent has ceased. Operationally, tolerance can be demonstrated by the lack of a T cell response upon reexposure to specific antigen in the absence of the tolerizing agent.

Down regulating or preventing one or more antigen functions (including without limitation B lymphocyte antigen functions (such as, for example, B7)), e.g., preventing high level lymphokine synthesis by activated T cells, will be useful in situations of tissue, skin and organ transplantation and in graft-versus-host disease (GVHD). For example, blockage of T cell function should result in reduced tissue destruction in tissue transplantation. Typically, in tissue transplants, rejection of the transplant is initiated through its recognition as foreign by T cells, followed by an immune reaction that destroys the transplant. The administration of a therapeutic composition of the invention may prevent cytokine synthesis by immune cells, such as T cells, and thus acts as an immunosuppressant. Moreover, a lack of costimulation may also be sufficient to anergize the T cells, thereby inducing tolerance in a subject. Induction of long-term tolerance by B lymphocyte antigen-blocking reagents may avoid the necessity of repeated administration of these blocking reagents. To achieve sufficient immunosuppression or tolerance in a subject, it may also be necessary to block the function of a combination of B lymphocyte antigens.

The efficacy of particular therapeutic compositions in preventing organ transplant rejection or GVHD can be assessed using animal models that are predictive of efficacy in humans. Examples of appropriate systems which can be used include allogeneic cardiac grafts in rats and xenogeneic pancreatic islet cell grafts in mice, both of which have been used to examine the immunosuppressive effects of CTLA4Ig fusion proteins in vivo as described in Lenschow et al., Science 257:789–792 (1992) and Turka et al., Proc. Natl. Acad. Sci USA, 89:11102–11105 (1992). In addition, murine models of GVHD (see Paul ed., Fundamental Immunology, Raven Press, New York, 1989, pp. 846–847) can be used to determine the effect of therapeutic compositions of the invention on the development of that disease.

Blocking antigen function may also be therapeutically useful for treating autoimmune diseases. Many autoimmune disorders are the result of inappropriate activation of T cells that are reactive against self tissue and which promote the production of cytokines and autoantibodies involved in the pathology of the diseases. Preventing the activation of autoreactive T cells may reduce or eliminate disease symptoms. Administration of reagents which block stimulation of T cells can be used to inhibit T cell activation and prevent production of autoantibodies or T cell-derived cytokines which may be involved in the disease process. Additionally, blocking reagents may induce antigen-specific tolerance of autoreactive T cells which could lead to long-term relief from the disease. The efficacy of blocking reagents in preventing or alleviating autoimmune disorders can be determined using a number of well-characterized animal models of human autoimmune diseases. Examples include murine experimental autoimmune encephalitis, systemic lupus erythmatosis in MRL/lpr/lpr mice or NZB hybrid mice, murine autoimmune collagen arthritis, diabetes mellitus in NOD mice and BB rats, and murine experimental myasthenia gravis (see Paul ed., Fundamental Immunology, Raven Press, New York, 1989, pp. 840–856).

Upregulation of an antigen function (e.g., a B lymphocyte antigen function), as a means of up regulating immune responses, may also be useful in therapy. Upregulation of immune responses may be in the form of enhancing an existing immune response or eliciting an initial immune response. For example, enhancing an immune response may be useful in cases of viral infection, including systemic viral diseases such as influenza, the common cold, and encephalitis.

Alternatively, anti-viral immune responses may be enhanced in an infected patient by removing T cells from the patient, costimulating the T cells in vitro with viral antigen-pulsed APCs either expressing a peptide of the present invention or together with a stimulatory form of a soluble peptide of the present invention and reintroducing the in vitro activated T cells into the patient. Another method of enhancing anti-viral immune responses would be to isolate infected cells from a patient, transfect them with a nucleic acid encoding a protein of the present invention as described herein such that the cells express all or a portion of the protein on their surface, and reintroduce the transfected cells into the patient. The infected cells would now be capable of delivering a costimulatory signal to, and thereby activate, T cells in vivo.

A polypeptide of the present invention may provide the necessary stimulation signal to T cells to induce a T cell mediated immune response against the transfected tumor cells. In addition, tumor cells which lack MHC class I or MHC class II molecules, or which fail to reexpress sufficient mounts of MHC class I or MHC class II molecules, can be transfected with nucleic acid encoding all or a portion of (e.g., a cytoplasmic-domain truncated portion) of an MHC class I alpha chain protein and $\beta_2$ microglobulin protein or an MHC class II alpha chain protein and an MHC class II beta chain protein to thereby express MHC class I or MHC class II proteins on the cell surface. Expression of the appropriate class I or class II MHC in conjunction with a peptide having the activity of a B lymphocyte antigen (e.g., B7-1, B7-2, B7-3) induces a T cell mediated immune response against the transfected tumor cell. Optionally, a gene encoding an antisense construct which blocks expression of an MHC class II associated protein, such as the invariant chain, can also be cotransfected with a DNA encoding a peptide having the activity of a B lymphocyte antigen to promote presentation of tumor associated antigens and induce tumor specific immunity. Thus, the induction of a T cell mediated immune response in a human subject may be sufficient to overcome tumor-specific tolerance in the subject.

The activity of a protein of the invention may, among other means, be measured by the following methods:

Suitable assays for thymocyte or splenocyte cytotoxicity include, without limitation, those described in: Current Protocols in Immunology, Ed by J. E. Coligan, A. M. Kruisbeek, D. H. Margulies, E. M. Shevach, W. Strober, Pub. Greene Publishing Associates and Wiley-Interscience (Chapter 3, In Vitro assays for Mouse Lymphocyte Function 3.1–3.19; Chapter 7, Immunologic studies in Humans); Herrmann et al., Proc. Natl. Acad. Sci. USA 78:2488–2492, 1981; Herrmann et al., J. Immunol. 128:1968–1974, 1982; Handa et al., J. Immunol. 135:1564–1572, 1985; Takai et al., I. Immunol. 137:3494–3500, 1986; Takai et al., J. Immunol. 140:508–512, 1988; Bowman et al., J. Virology 61:1992–1998; Bertagnolli et al., Cellular Immunology 133:327–341, 1991; Brown et al., J. Immunol. 153:3079–3092, 1994.

Assays for T-cell-dependent immunoglobulin responses and isotype switching (which will identify, among others, proteins that modulate T-cell dependent antibody responses and that affect Th1/Th2 profiles) include, without limitation, those described in: Maliszewski, J. Immunol. 144:3028–3033, 1990; and Assays for B cell function: In vitro antibody production, Mond, J. J. and Brunswick, M. In Current Protocols in Immunology. J. E. e.a. Coligan eds. Vol 1 pp. 3.8.1–3.8.16, John Wiley and Sons, Toronto. 1994.

Mixed lymphocyte reaction (MLR) assays (which will identify, among others, proteins that generate predominantly Th1 and CTL responses) include, without limitation, those described in: Current Protocols in Immunology, Ed by J. E. Coligan, A. M. Kruisbeek, D. H. Margulies, E. M. Shevach, W. Strober, Pub. Greene Publishing Associates and Wiley-Interscience (Chapter 3, In Vitro assays for Mouse Lymphocyte Function 3.1–3.19; Chapter 7, Immunologic studies in Humans); Takai et al., J. Immunol. 137:3494–3500, 1986; Takai et al., J. Immunol. 140:508–512, 1988; Bertagnolli et al., J. Immunol. 149:3778–3783, 1992.

Dendritic cell-dependent assays (which will identify, among others, proteins expressed by dendritic cells that activate naive T-cells) include, without limitation, those described in: Guery et al., J. Immunol. 134:536–544, 1995; Inaba et al., Journal of Experimental Medicine 173:549–559, 1991; Macatonia et al., Journal of Immunology 154:5071–5079, 1995; Porgador et al., Journal of Experimental Medicine 182:255–260, 1995; Nair et al., Journal of Virology 67:4062–4069, 1993; Huang et al., Science 264:961–965, 1994; Macatonia et al., Journal of Experimental Medicine 169:1255–1264, 1989; Bhardwaj et al., Journal of Clinical Investigation 94:797–807, 1994; and Inaba et al., Journal of Experimental Medicine 172:631–640, 1990.

Assays for lymphocyte survival/apoptosis (which will identify, among others, proteins that prevent apoptosis after superantigen induction and proteins that regulate lymphocyte homeostasis) include, without limitation, those described in: Darzynkiewicz et al., Cytometry 13:795–808, 1992; Gorczyca et al., Leukemia 7:659–670, 1993; Gorczyca et al., Cancer Research 53:1945–1951, 1993; Itoh et al., Cell 66:233–243, 1991; Zacharchuk, Journal of Immunology 145:4037–4045, 1990; Zamai et al., Cytometry 14:891–897, 1993; Gorczyca et al., International Journal of Oncology 1:639–648, 1992.

Assays for proteins that influence early steps of T-cell commitment and development include, without limitation, those described in: Antica et al., Blood 84:111–117, 1994; Fine et al., Cellular Immunology 155:111–122, 1994; Galy et al., Blood 85:2770–2778, 1995; Toki et al., Proc. Nat. Acad. Sci. USA 88:7548–7551, 1991.

4.10.8 Activin/Inhibin Activity

A polypeptide of the present invention may also exhibit activin- or inhibin-related activities. A polynucleotide of the invention may encode a polypeptide exhibiting such characteristics. Inhibins are characterized by their ability to inhibit the release of follicle stimulating hormone (FSH), while activins and are characterized by their ability to stimulate the release of follicle stimulating hormone (FSH). Thus, a polypeptide of the present invention, alone or in heterodimers with a member of the inhibin family, may be useful as a contraceptive based on the ability of inhibins to decrease fertility in female mammals and decrease spermatogenesis in male mammals. Administration of sufficient amounts of other inhibins can induce infertility in these mammals. Alternatively, the polypeptide of the invention, as a homodimer or as a heterodimer with other protein subunits of the inhibin group, may be useful as a fertility inducing therapeutic, based upon the ability of activin molecules in stimulating FSH release from cells of the anterior pituitary. See, for example, U.S. Pat. No. 4,798,885. A polypeptide of the invention may also be useful for advancement of the onset of fertility in sexually immature mammals, so as to increase the lifetime reproductive performance of domestic animals such as, but not limited to, cows, sheep and pigs.

The activity of a polypeptide of the invention may, among other means, be measured by the following methods.

Assays for activin/inhibin activity include, without limitation, those described in: Vale et al., Endocrinology 91:562–572, 1972; Ling et al., Nature 321:779–782, 1986; Vale et al., Nature 321:776–779, 1986; Mason et al., Nature 318:659–663, 1985; Forage et al., Proc. Natl. Acad. Sci. USA 83:3091–3095, 1986.

4.10.9 Chemotactic/Chemokinetic Activity

A polypeptide of the present invention may be involved in chemotactic or chemokinetic activity for mammalian cells, including, for example, monocytes, fibroblasts, neutrophils, T-cells, mast cells, eosinophils, epithelial and/or endothelial cells. A polynucleotide of the invention can encode a polypeptide exhibiting such attributes. Chemotactic and chemokinetic receptor activation can be used to mobilize or attract a desired cell population to a desired site of action. Chemotactic or chemokinetic compositions (e.g. proteins, antibodies, binding partners, or modulators of the invention) provide particular advantages in treatment of wounds and other trauma to tissues, as well as in treatment of localized infections. For example, attraction of lymphocytes, monocytes or neutrophils to tumors or sites of infection may result in improved immune responses against the tumor or infecting agent.

A protein or peptide has chemotactic activity for a particular cell population if it can stimulate, directly or indirectly, the directed orientation or movement of such cell population. Preferably, the protein or peptide has the ability to directly stimulate directed movement of cells. Whether a particular protein has chemotactic activity for a population of cells can be readily determined by employing such protein or peptide in any known assay for cell chemotaxis.

Therapeutic compositions of the invention can be used in the following:

Assays for chemotactic activity (which will identify proteins that induce or prevent chemotaxis) consist of assays that measure the ability of a protein to induce the migration of cells across a membrane as well as the ability of a protein to induce the adhesion of one cell population to another cell population. Suitable assays for movement and adhesion include, without limitation, those described in: Current Protocols in Immunology, Ed by J. E. Coligan, A. M. Kruisbeek, D. H. Marguiles, E. M. Shevach, W. Strober, Pub. Greene Publishing Associates and Wiley-Interscience (Chapter 6.12, Measurement of alpha and beta Chemokines 6.12.1–6.12.28; Taub et al. J. Clin. Invest. 95:1370–1376, 1995; Lind et al. APMIS 103:140–146, 1995; Muller et al Eur. J. Immunol. 25:1744–1748; Gruber et al. J. of Immunol. 152:5860–5867, 1994; Johnston et al. J. of Immunol. 153:1762–1768, 1994.

4.10.10 Hemostatic and Thrombolytic Activity

A polypeptide of the invention may also be involved in hemostatis or thrombolysis or thrombosis. A polynucleotide of the invention can encode a polypeptide exhibiting such attributes. Compositions may be useful in treatment of various coagulation disorders (including hereditary disorders, such as hemophilias) or to enhance coagulation and other hemostatic events in treating wounds resulting from trauma, surgery or other causes. A composition of the invention may also be useful for dissolving or inhibiting formation of thromboses and for treatment and prevention of conditions resulting therefrom (such as, for example, infarction of cardiac and central nervous system vessels (e.g., stroke).

Therapeutic compositions of the invention can be used in the following:

Assay for hemostatic and thrombolytic activity include, without limitation, those described in: Linet et al., J. Clin. Pharmacol. 26:131–140, 1986; Burdick et al., Thrombosis Res. 45:413–419, 1987; Humphrey et al., Fibrinolysis 5:71–79 (1991); Schaub, Prostaglandins 35:467–474, 1988.

4.10.11 Cancer Diagnosis and Therapy

Polypeptides of the invention may be involved in cancer cell generation, proliferation or metastasis. Detection of the presence or amount of polynucleotides or polypeptides of the invention may be useful for the diagnosis and/or prognosis of one or more types of cancer. For example, the presence or increased expression of a polynucleotide/polypeptide of the invention may indicate a hereditary risk of cancer, a precancerous condition, or an ongoing malignancy. Conversely, a defect in the gene or absence of the polypeptide may be associated with a cancer condition. Identification of single nucleotide polymorphisms associated with cancer or a predisposition to cancer may also be useful for diagnosis or prognosis.

Cancer treatments promote tumor regression by inhibiting tumor cell proliferation, inhibiting angiogenesis (growth of new blood vessels that is necessary to support tumor growth) and/or prohibiting metastasis by reducing tumor cell motility or invasiveness. Therapeutic compositions of the invention may be effective in adult and pediatric oncology including in solid phase tumors/malignancies, locally advanced tumors, human soft tissue sarcomas, metastatic cancer, including lymphatic metastases, blood cell malignancies including multiple myeloma, acute and chronic leukemias, and lymphomas, head and neck cancers including mouth cancer, larynx cancer and thyroid cancer, lung cancers including small cell carcinoma and non-small cell cancers, breast cancers including small cell carcinoma and ductal carcinoma, gastrointestinal cancers including esophageal cancer, stomach cancer, colon cancer, colorectal cancer and polyps associated with colorectal neoplasia, pancreatic cancers, liver cancer, urologic cancers including bladder cancer and prostate cancer, malignancies of the female genital tract including ovarian carcinoma, uterine (including endometrial) cancers, and solid tumor in the ovarian follicle, kidney cancers including renal cell carcinoma, brain cancers including intrinsic brain tumors, neuroblastoma, astrocytic brain tumors, gliomas, metastatic tumor cell invasion in the central nervous system, bone cancers including osteomas, skin cancers including malignant melanoma, tumor progression of human skin keratinocytes, squamous cell carcinoma, basal cell carcinoma, hemangiopericytoma and Karposi's sarcoma.

Polypeptides, polynucleotides, or modulators of polypeptides of the invention (including inhibitors and stimulators of the biological activity of the polypeptide of the invention) may be administered to treat cancer. Therapeutic compositions can be administered in therapeutically effective dosages alone or in combination with adjuvant cancer therapy such as surgery, chemotherapy, radiotherapy, thermotherapy, and laser therapy, and may provide a beneficial effect, e.g. reducing tumor size, slowing rate of tumor growth, inhibiting metastasis, or otherwise improving overall clinical condition, without necessarily eradicating the cancer.

The composition can also be administered in therapeutically effective amounts as a portion of an anti-cancer cocktail. An anti-cancer cocktail is a mixture of the polypeptide or modulator of the invention with one or more anti-cancer drugs in addition to a pharmaceutically acceptable carrier for delivery. The use of anti-cancer cocktails as a cancer treatment is routine. Anti-cancer drugs that are well known in the art and can be used as a treatment in combination with the polypeptide or modulator of the invention include: Actinomycin D, Aminoglutethimide, Asparaginase, Bleomycin, Busulfan, Carboplatin, Carmustine, Chlorambucil, Cisplatin (cis-DDP), Cyclophosphamide, Cytarabine HCl (Cytosine arabinoside), Dacarbazine, Dactinomycin, Daunorubicin HCl, Doxorubicin HCl, Estramustine phosphate sodium, Etoposide (V16-213), Floxuridine, 5-Fluorouracil (5-Fu), Flutamide, Hydroxyurea (hydroxycarbamide), Ifosfamide, Interferon Alpha-2a, Interferon Alpha-2b, Leuprolide acetate (LHRH-releasing factor analog), Lomustine, Mechlorethamine HCl (nitrogen mustard), Melphalan, Mercaptopurine, Mesna, Methotrexate (MTX), Mitomycin, Mitoxantrone HCl, Octreotide, Plicamycin, Procarbazine HCl, Streptozocin, Tamoxifen citrate, Thioguanine, Thiotepa, Vinblastine sulfate, Vincristine sulfate, Amsacrine, Azacitidine, Hexamethylmelamine, Interleukin-2, Mitoguazone, Pentostatin, Semustine, Teniposide, and Vindesine sulfate.

In addition, therapeutic compositions of the invention may be used for prophylactic treatment of cancer. There are hereditary conditions and/or environmental situations (e.g. exposure to carcinogens) known in the art that predispose an individual to developing cancers. Under these circumstances, it may be beneficial to treat these individuals with therapeutically effective doses of the polypeptide of the invention to reduce the risk of developing cancers.

In vitro models can be used to determine the effective doses of the polypeptide of the invention as a potential cancer treatment. These in vitro models include proliferation assays of cultured tumor cells, growth of cultured tumor cells in soft agar (see Freshney, (1987) Culture of Animal Cells: A Manual of Basic Technique, Wily-Liss, New York, N.Y. Ch 18 and Ch 21), tumor systems in nude mice as described in Giovanella et al., J. Natl. Can. Inst., 52: 921–30 (1974), mobility and invasive potential of tumor cells in Boyden Chamber assays as described in Pilkington et al., Anticancer Res., 17: 4107–9 (1997), and angiogenesis assays such as induction of vascularization of the chick chorioallantoic membrane or induction of vascular endothelial cell migration as described in Ribatta et al., Intl. J. Dev. Biol., 40: 1189–97 (1999) and Li et al., Clin. Exp. Metastasis, 17:423–9 (1999), respectively. Suitable tumor cells lines are available, e.g. from American Type Tissue Culture Collection catalogs.

4.10.12 Receptor/Ligand Activity

A polypeptide of the present invention may also demonstrate activity as receptor, receptor ligand or inhibitor or agonist of receptor/ligand interactions. A polynucleotide of the invention can encode a polypeptide exhibiting such characteristics. Examples of such receptors and ligands include, without limitation, cytokine receptors and their ligands, receptor kinases and their ligands, receptor phosphatases and their ligands, receptors involved in cell-cell interactions and their ligands (including without limitation, cellular adhesion molecules (such as selecting, integrins and their ligands) and receptor/ligand pairs involved in antigen presentation, antigen recognition and development of cellular and humoral immune responses. Receptors and ligands are also useful for screening of potential peptide or small molecule inhibitors of the relevant receptor/ligand interaction. A protein of the present invention (including, without limitation, fragments of receptors and ligands) may themselves be useful as inhibitors of receptor/ligand interactions.

The activity of a polypeptide of the invention may, among other means, be measured by the following methods:

Suitable assays for receptor-ligand activity include without limitation those described in: Current Protocols in Immunology, Ed by J. E. Coligan, A. M. Kruisbeek, D. H. Margulies, E. M. Shevach, W. Strober, Pub. Greene Publishing Associates and Wiley-Interscience (Chapter 7.28, Measurement of Cellular Adhesion under static conditions 7.28.1–7.28.22), Takai et al., Proc. Natl. Acad. Sci. USA 84:6864–6868, 1987; Bierer et al., J. Exp. Med. 168:1145–1156, 1988; Rosenstein et al., J. Exp. Med. 169:149–160 1989; Stoltenborg et al., J. Immunol. Methods 175:59–68, 1994; Stitt et al., Cell 80:661–670, 1995.

By way of example, the polypeptides of the invention may be used as a receptor for a ligand(s) thereby transmitting the biological activity of that ligand(s). Ligands may be identified through binding assays, affinity chromatography, dihybrid screening assays, BIAcore assays, gel overlay assays, or other methods known in the art.

Studies characterizing drugs or proteins as agonist or antagonist or partial agonists or a partial antagonist require the use of other proteins as competing ligands. The polypeptides of the present invention or ligand(s) thereof may be labeled by being coupled to radioisotopes, colorimetric molecules or a toxin molecules by conventional methods. ("Guide to Protein Purification" Murray P. Deutscher (ed) Methods in Enzymology Vol. 182 (1990) Academic Press, Inc. San Diego). Examples of radioisotopes include, but are not limited to, tritium and carbon-14 . Examples of calorimetric molecules include, but are not limited to, fluorescent molecules such as fluorescamnine, or rhodamine or other colorimetric molecules. Examples of toxins include, but are not limited, to ricin.

4.10.13 Drug Screening

This invention is particularly useful for screening chemical compounds by using the novel polypeptides or binding fragments thereof in any of a variety of drug screening techniques. The polypeptides or fragments employed in such a test may either be free in solution, affixed to a solid support, borne on a cell surface or located intracellularly. One method of drug screening utilizes eukaryotic or prokaryotic host cells which are stably transformed with recombinant nucleic acids expressing the polypeptide or a fragment thereof. Drugs are screened against such transformed cells in competitive binding assays. Such cells, either in viable or fixed form, can be used for standard binding assays. One may measure, for example, the formation of complexes between polypeptides of the invention or fragments and the agent being tested or examine the diminution in complex formation between the novel polypeptides and an appropriate cell line, which are well known in the art.

Sources for test compounds that may be screened for ability to bind to or modulate (i.e., increase or decrease) the activity of polypeptides of the invention include (1) inorganic and organic chemical libraries, (2) natural product libraries, and (3) combinatorial libraries comprised of either random or mimetic peptides, oligonucleotides or organic molecules.

Chemical libraries may be readily synthesized or purchased from a number of commercial sources, and may include structural analogs of known compounds or compounds that are identified as "hits" or "leads" via natural product screening.

The sources of natural product libraries are microorganisms (including bacteria and fungi), animals, plants or other vegetation, or marine organisms, and libraries of mixtures for screening may be created by: (1) fermentation and extraction of broths from soil, plant or marine microorganisms or (2) extraction of the organisms themselves. Natural product libraries include polyketides, non-ribosomal peptides, and (non-naturally occurring) variants thereof. For a review, see Science 282:63–68 (1998).

Combinatorial libraries are composed of large numbers of peptides, oligonucleotides or organic compounds and can be readily prepared by traditional automated synthesis methods, PCR, cloning or proprietary synthetic methods. Of particular interest are peptide and oligonucleotide combinatorial libraries. Still other libraries of interest include peptide, protein, peptidomimetic, multiparallel synthetic collection, recombinatorial, and polypeptide libraries. For a review of combinatorial chemistry and libraries created therefrom, see Myers, Curr. Opin. Biotechnol. 8:701–707 (1997). For reviews and examples of peptidomimetic libraries, see Al-Obeidi et al., Mol. Biotechnol, 9(3):205–23 (1998); Hruby et al., Curr Opin Chem Biol, 1(1):114–19 (1997); Dorner et al., Bioorg Med Chem, 4(5):709–15 (1996) (alkylated dipeptides).

Identification of modulators through use of the various libraries described herein permits modification of the candidate "hit" (or "lead") to optimize the capacity of the "hit" to bind a polypeptide of the invention. The molecules identified in the binding assay are then tested for antagonist or agonist activity in in vivo tissue culture or animal models that are well known in the art. In brief, the molecules are titrated into a plurality of cell cultures or animals and then tested for either cell/animal death or prolonged survival of the animal/cells.

The binding molecules thus identified may be complexed with toxins, e.g., ricin or cholera, or with other compounds that are toxic to cells such as radioisotopes. The toxin-binding molecule complex is then targeted to a tumor or other cell by the specificity of the binding molecule for a polypeptide of the invention. Alternatively, the binding molecules may be complexed with imaging agents for targeting and imaging purposes.

4.10.14 Assay for Receptor Activity

The invention also provides methods to detect specific binding of a polypeptide e.g. a ligand or a receptor. The art provides numerous assays particularly useful for identifying previously unknown binding partners for receptor polypeptides of the invention. For example, expression cloning using mammalian or bacterial cells, or dihybrid screening assays can be used to identify polynucleotides encoding binding partners. As another example, affinity chromatography with the appropriate immobilized polypeptide of the invention can be used to isolate polypeptides that recognize and bind polypeptides of the invention. There are a number of different libraries used for the identification of compounds, and in particular small molecules, that modulate (i.e., increase or decrease) biological activity of a polypeptide of the invention. Ligands for receptor polypeptides of the invention can also be identified by adding exogenous ligands, or cocktails of ligands to two cells populations that are genetically identical except for the expression of the receptor of the invention: one cell population expresses the receptor of the invention whereas the other does not. The response of the two cell populations to the addition of ligands(s) are then compared. Alternatively, an expression library can be co-expressed with the polypeptide of the invention in cells and assayed for an autocrine response to identify potential ligand(s). As still another example, BIAcore assays, gel overlay assays, or other methods known in the art can be used to identify binding partner polypeptides, including, (1) organic and inorganic chemical libraries, (2) natural product libraries, and (3) combinatorial libraries comprised of random peptides, oligonucleotides or organic molecules.

The role of downstream intracellular signaling molecules in the signaling cascade of the polypeptide of the invention can be determined. For example, a chimeric protein in which the cytoplasmic domain of the polypeptide of the invention is fused to the extracellular portion of a protein, whose ligand has been identified, is produced in a host cell. The cell is then incubated with the ligand specific for the extracellular portion of the chimeric protein, thereby activating the chimeric receptor. Known downstream proteins involved in intracellular signaling can then be assayed for expected modifications i.e. phosphorylation. Other methods known to those in the art can also be used to identify signaling molecules involved in receptor activity.

4.10.15 Anti-inflammatory Activity

Compositions of the present invention may also exhibit anti-inflammatory activity. The anti-inflammatory activity may be achieved by providing a stimulus to cells involved in the inflammatory response, by inhibiting or promoting cell-cell interactions (such as, for example, cell adhesion), by inhibiting or promoting chemotaxis of cells involved in the inflammatory process, inhibiting or promoting cell extravasation, or by stimulating or suppressing production of other factors which more directly inhibit or promote an inflammatory response. Compositions with such activities can be used to treat inflammatory conditions including chronic or acute conditions), including without limitation intimation associated with infection (such as septic shock, sepsis or systemic inflammatory response syndrome (SIRS)), ischemia-reperfusion injury, endotoxin lethality, arthritis, complement-mediated hyperacute rejection, nephritis, cytokine or chemokine-induced lung injury, inflammatory bowel disease, Crohn's disease or resulting from over production of cytokines such as TNF or IL-1. Compositions of the invention may also be useful to treat anaphylaxis and hypersensitivity to an antigenic substance or material. Compositions of this invention may be utilized to prevent or treat conditions such as, but not limited to, sepsis, acute pancreatitis, endotoxin shock, cytokine induced shock, rheumatoid arthritis, chronic inflammatory arthritis, pancreatic cell damage from diabetes mellitus type 1, graft versus host disease, inflammatory bowel disease, inflammation associated with pulmonary disease, other autoimmune disease or inflammatory disease, an antiproliferative agent such as for acute or chronic mylegenous leukemia or in the prevention of premature labor secondary to intrauterine infections.

4.10.16 Leukemias

Leukemias and related disorders may be treated or prevented by administration of a therapeutic that promotes or inhibits function of the polynucleotides and/or polypeptides of the invention. Such leukemias and related disorders include but are not limited to acute leukemia, acute lymphocytic leukemia, acute myelocytic leukemia, myeloblastic, promyelocytic, myelomonocytic, monocytic, erythroleukemia, chronic leukemia, chronic myelocytic (granulocytic) leukemia and chronic lymphocytic leukemia (for a review of such disorders, see Fishman et al., 1985, Medicine, 2d Ed., J. B. Lippincott Co., Philadelphia).

4.10.17 Nervous System Disorders

Nervous system disorders, involving cell types which can be tested for efficacy of intervention with compounds that modulate the activity of the polynucleotides and/or polypeptides of the invention, and which can be treated upon thus observing an indication of therapeutic utility, include but are not limited to nervous system injuries, and diseases or disorders which result in either a disconnection of axons, a diminution or degeneration of neurons, or demyelination. Nervous system lesions which may be treated in a patient (including human and non-human mammalian patients) according to the invention include but are not limited to the following lesions of either the central (including spinal cord, brain) or peripheral nervous systems:

(i) traumatic lesions, including lesions caused by physical injury or associated with surgery, for example, lesions which sever a portion of the nervous system, or compression injuries;

(ii) ischemic lesions, in which a lack of oxygen in a portion of the nervous system results in neuronal injury or death, including cerebral infarction or ischemia, or spinal cord infarction or ischemia;

(iii) infectious lesions, in which a portion of the nervous system is destroyed or injured as a result of infection, for example, by an abscess or associated with infection by human immunodeficiency virus, herpes zoster, or herpes simplex virus or with Lyme disease, tuberculosis, syphilis;

(iv) degenerative lesions, in which a portion of the nervous system is destroyed or injured as a result of a degenerative process including but not limited to degeneration associated with Parkinson's disease, Alzheimer's disease, Huntington's chorea, or amyotrophic lateral sclerosis;

(v) lesions associated with nutritional diseases or disorders, in which a portion of the nervous system is destroyed or injured by a nutritional disorder or disorder of metabolism including but not limited to, vitamin B12 deficiency, folic acid deficiency, Wemicke disease, tobacco-alcohol amblyopia, Marchiafava-Bignami disease primary degeneration of the corpus callosum), and alcoholic cerebellar degeneration;

(vi) neurological lesions associated with systemic diseases including but not limited to diabetes (diabetic neuropathy, Bell's palsy), systemic lupus erythematosus, carcinoma, or sarcoidosis;

(vii) lesions caused by toxic substances including alcohol, lead, or particular neurotoxins; and (viii) demyelinated lesions in which a portion of the nervous system is destroyed or injured by a demyelinating disease including but not limited to multiple sclerosis, human immunodeficiency virus-associated myelopathy, transverse myelopathy or various etiologies, progressive multifocal leukoencephalopathy, and central pontine myelinolysis.

Therapeutics which are useful according to the invention for treatment of a nervous system disorder may be selected by testing for biological activity in promoting the survival or differentiation of neurons. For example, and not by way of limitation, therapeutics which elicit any of the following effects may be useful according to the invention:

(i) increased survival time of neurons in culture;

(ii) increased sprouting of neurons in culture or in vivo;

(iii) increased production of a neuron-associated molecule in culture or in vivo, e.g., choline acetyltransferase or acetylcholinesterase with respect to motor neurons; or (iv) decreased symptoms of neuron dysfunction in vivo.

Such effects may be measured by any method known in the art. In preferred, non-limiting embodiments, increased survival of neurons may be measured by the method set forth in Arakawa et al. (1990, J. Neurosci. 10:3507–3515); increased sprouting of neurons may be detected by methods set forth in Pestronk et al. (1980, Exp. Neurol. 70:65–82) or Brown et al. (1981, Ann. Rev. Neurosci. 4:17–42); increased production of neuron-associated molecules may be measured by bioassay, enzymatic assay, antibody binding, Northern blot assay, etc., depending on the molecule to be measured; and motor neuron dysfunction may be measured by assessing the physical manifestation of motor neuron disorder, e.g., weakness, motor neuron conduction velocity, or functional disability.

In specific embodiments, motor neuron disorders that may be treated according to the invention include but are not limited to disorders such as infarction, infection, exposure to toxin, trauma, surgical damage, degenerative disease or malignancy that may affect motor neurons as well as other components of the nervous system, as well as disorders that selectively affect neurons such as amyotrophic lateral sclerosis, and including but not limited to progressive spinal muscular atrophy, progressive bulbar palsy, primary lateral sclerosis, infantile and juvenile muscular atrophy, progressive bulbar paralysis of childhood (Fazio-Londe syndrome), poliomyelitis and the post polio syndrome, and Hereditary Motorsensory Neuropathy (Charcot-Marie-Tooth Disease).

4.10.18 Other Activities

A polypeptide of the invention may also exhibit one or more of the following additional activities or effects: inhibiting the growth, infection or function of, or killing, infectious agents, including, without limitation, bacteria, viruses, fungi and other parasites; effecting (suppressing or enhancing) bodily characteristics, including, without limitation, height, weight, hair color, eye color, skin, fat to lean ratio or other tissue pigmentation, or organ or body part size or shape (such as, for example, breast augmentation or diminution, change in bone form or shape); effecting biorhythms or circadian cycles or rhythms; effecting the fertility of male or female subjects; effecting the metabolism, catabolism, anabolism, processing, utilization, storage or elimination of dietary fat, lipid, protein, carbohydrate, vitamins, minerals, co-factors or other nutritional factors or component(s); effecting behavioral characteristics, including, without limitation, appetite, libido, stress, cognition (including cognitive disorders), depression (including depressive disorders) and violent behaviors; providing analgesic effects or other pain reducing effects; promoting differentiation and growth of embryonic stem cells in lineages other than hematopoietic lineages; hormonal or endocrine activity; in the case of enzymes, correcting deficiencies of the enzyme and treating deficiency-related diseases; treatment of hyperproliferative disorders (such as, for example, psoriasis); immunoglobulin-like activity (such as, for example, the ability to bind antigens or complement); and the ability to act as an antigen in a vaccine composition to raise an immune response against such protein or another material or entity which is cross-reactive with such protein.

4.10.19 Identification of Polymorphisms

The demonstration of polymorphisms makes possible the identification of such polymorphisms in human subjects and the pharmacogenetic use of this information for diagnosis and treatment. Such polymorphisms may be associated with, e.g., differential predisposition or susceptibility to various disease states (such as disorders involving inflammation or immune response) or a differential response to drug administration, and this genetic information can be used to tailor preventive or therapeutic treatment appropriately. For example, the existence of a polymorphism associated with a predisposition to inflammation or autoimmune disease makes possible the diagnosis of this condition in humans by identifying the presence of the polymorphism.

Polymorphisms can be identified in a variety of ways known in the art which all generally involve obtaining a sample from a patient, analyzing DNA from the sample, optionally involving isolation or amplification of the DNA, and identifying the presence of the polymorphism in the DNA. For example, PCR may be used to amplify an appropriate fragment of genomic DNA which may then be sequenced. Alternatively, the DNA may be subjected to allele-specific oligonucleotide hybridization (in which appropriate oligonucleotides are hybridized to the DNA under conditions permitting detection of a single base mismatch) or to a single nucleotide extension assay (in which an oligonucleotide that hybridizes immediately adjacent to the position of the polymnorphism is extended with one or more labeled nucleotides). In addition, traditional restriction fragment length polymorphism analysis (using restriction enzymes that provide differential digestion of the genomic DNA depending on the presence or absence of the polymorphism) may be performed. Arrays with nucleotide sequences of the present invention can be used to detect polymorphisms. The array can comprise modified nucleotide sequences of the present invention in order to detect the nucleotide sequences of the present invention. In the alternative, any one of the nucleotide sequences of the present invention can be placed on the array to detect changes from those sequences.

Alternatively a polymorphism resulting in a change in the amino acid sequence could also be detected by detecting a corresponding change in amino acid sequence of the protein, e.g., by an antibody specific to the variant sequence.

4.10.20 Arthritis and Inflammation

The immunosuppressive effects of the compositions of the invention against rheumatoid arthritis is determined in an experimental animal model system. The experimental model system is adjuvant induced arthritis in rats, and the protocol is described by J. Holoshitz, et at., 1983, Science, 219:56, or by B. Waksman et al., 1963, Int. Arch. Allergy Appl. Immunol., 23:129. Induction of the disease can be caused by a single injection, generally intradermally, of a suspension of killed Mycobacterium tuberculosis in complete Freund's adjuvant (CFA). The route of injection can vary, but rats may be injected at the base of the tail with an adjuvant mixture. The polypeptide is administered in phosphate buffered solution (PBS) at a dose of about 1–5 mg/kg. The control consists of administering PBS only.

The procedure for testing the effects of the test compound would consist of intradermally injecting killed Mycobacterium tuberculosis in CFA followed by immediately administering the test compound and subsequent treatment every other day until day 24. At 14, 15, 18, 20, 22, and 24 days after injection of Mycobacterium CFA, an overall arthritis score may be obtained as described by J. Holoskitz above. An analysis of the data would reveal that the test compound would have a dramatic affect on the swelling of the joints as measured by a decrease of the arthritis score.

4.11 Therapeutic Methods

The compositions (including polypeptide fragments, analogs, variants and antibodies or other binding partners or modulators including antisense polynucleotides) of the invention have numerous applications in a variety of therapeutic methods. Examples of therapeutic applications include, but are not limited to, those exemplified herein.

4.11.1 Example

One embodiment of the invention is the administration of an effective amount of the polypeptides or other composition of the invention to individuals affected by a disease or disorder that can be modulated by regulating the peptides of the invention. While the mode of administration is not particularly important, parenteral administration is preferred. An exemplary mode of administration is to deliver an intravenous bolus. The dosage of the polypeptides or other composition of the invention will normally be determined by the prescribing physician. It is to be expected that the dosage will vary according to the age, weight, condition and response of the individual patient. Typically, the amount of polypeptide administered per dose will be in the range of about 0.01 $\mu$g/kg to 100 mg/kg of body weight, with the preferred dose being about 0.1 $\mu$g/kg to 10 mg/kg of patient body weight. For parenteral administration, polypeptides of the invention will be formulated in an injectable form combined with a pharmaceutically acceptable parenteral vehicle. Such vehicles are well known in the art and examples include water, saline, Ringer's solution, dextrose solution, and solutions consisting of small amounts of the human serum albumin. The vehicle may contain minor amounts of additives that maintain the isotonicity and stability of the polypeptide or other active ingredient. The preparation of such solutions is within the skill of the art.

4.12 Pharmaceutical Formulations and Routes of Administration

A protein or other composition of the present invention (from whatever source derived, including without limitation from recombinant and non-recombinant sources and including antibodies and other binding partners of the polypeptides of the invention) may be administered to a patient in need, by itself, or in pharmaceutical compositions where it is mixed with suitable carriers or excipient(s) at doses to treat or ameliorate a variety of disorders. Such a composition may optionally contain (in addition to protein or other active ingredient and a carrier) diluents, fillers, salts, buffers, stabilizers, solubilizers, and other materials well known in the art. The term "pharmaceutically acceptable" means a non-toxic material that does not interfere with the effectiveness of the biological activity of the active ingredient(s). The characteristics of the carrier will depend on the route of administration. The pharmaceutical composition of the invention may also contain cytokines, lymphokines, or other hematopoietic factors such as M-CSF, GM-CSF, TNF, IL-1, IL-2, IL-3, IL-4, IL-5, IL-6, IL-7, IL-8, IL-9, IL-10, IL-11, IL-12, IL-13, IL-14, IL-15, IFN, TNF0, TNF1, TNF2, G-CSF, Meg-CSF, thrombopoietin, stem cell factor, and erythropoietin. In further compositions, proteins of the invention may be combined with other agents beneficial to the treatment of the disease or disorder in question. These agents include various growth factors such as epidermal growth factor (EGF), platelet-derived growth factor (PDGF), transforming growth factors (TGF-α and TGF-β), insulin-like growth factor (IGF), as well as cytokines described herein.

The pharmaceutical composition may further contain other agents which either enhance the activity of the protein or other active ingredient or complement its activity or use in treatment. Such additional factors and/or agents may be included in the pharmaceutical composition to produce a synergistic effect with protein or other active ingredient of the invention, or to minimize side effects. Conversely, protein or other active ingredient of the present invention may be included in formulations of the particular clotting factor, cytokine, lymphokine, other hematopoietic factor, thrombolytic or anti-thrombotic factor, or anti-inflammatory agent to minimize side effects of the clotting factor, cytokine, lymphokine, other hematopoietic factor, thrombolytic or anti-thrombotic factor, or anti-inflammatory agent (such as IL-1Ra, IL-1 Hy1, IL-1 Hy2, anti-TNF, corticosteroids, immunosuppressive agents). A protein of the present invention may be active in multimers (e.g., heterodimers or homodimers) or complexes with itself or other proteins. As a result, pharmaceutical compositions of the invention may comprise a protein of the invention in such multimeric or complexed form.

As an alternative to being included in a pharmaceutical composition of the invention including a first protein, a second protein or a therapeutic agent may be concurrently administered with the first protein (e.g., at the same time, or at differing times provided that therapeutic concentrations of the combination of agents is achieved at the treatment site). Techniques for formulation and administration of the compounds of the instant application may be found in "Remington's Pharmaceutical Sciences," Mack Publishing Co., Easton, Pa., latest edition. A therapeutically effective dose further refers to that amount of the compound sufficient to result in amelioration of symptoms, e.g., treatment, healing, prevention or amelioration of the relevant medical condition, or an increase in rate of treatment, healing, prevention or amelioration of such conditions. When applied to an individual active ingredient, administered alone, a therapeutically effective dose refers to that ingredient alone. When applied to a combination, a therapeutically effective dose refers to combined amounts of the active ingredients that result in the therapeutic effect, whether administered in combination, serially or simultaneously.

In practicing the method of treatment or use of the present invention, a therapeutically effective amount of protein or other active ingredient of the present invention is administered to a mammal having a condition to be treated. Protein or other active ingredient of the present invention may be administered in accordance with the method of the invention either alone or in combination with other therapies such as treatments employing cytokines, lymphokines or other hematopoietic factors. When co-administered with one or more cytokines, lymphokines or other hematopoietic factors, protein or other active ingredient of the present invention may be administered either simultaneously with the cytokine(s), lymphokine(s), other hematopoietic factor (s), thrombolytic or anti-thrombotic factors, or sequentially. If administered sequentially, the attending physician will decide on the appropriate sequence of administering protein or other active ingredient of the present invention in combination with cytokine(s), lymphokine(s), other hematopoietic factor(s), thrombolytic or anti-thrombotic factors.

4.12.1 Routes of Administration

Suitable routes of administration may, for example, include oral, rectal, transmucosal, or intestinal administration; parenteral delivery, including intramuscular, subcutaneous, intramedullary injections, as well as intrathecal, direct intraventricular, intravenous, intraperitoneal, intranasal, or intraocular injections. Administration of protein or other active ingredient of the present invention used in the pharmaceutical composition or to practice the method of the present invention can be carried out in a variety of conventional ways, such as oral ingestion, inhalation, topical application or cutaneous, subcutaneous, intraperitoneal, parenteral or intravenous injection. Intravenous administration to the patient is preferred.

Alternately, one may administer the compound in a local rather than systemic manner, for example, via injection of the compound directly into a arthritic joints or in fibrotic tissue, often in a depot or sustained release formulation. In order to prevent the scarring process frequently occurring as complication of glaucoma surgery, the compounds may be administered topically, for example, as eye drops. Furthermore, one may administer the drug in a targeted drug delivery system, for example, in a liposome coated with a specific antibody, targeting, for example, arthritic or fibrotic tissue. The liposomes will be targeted to and taken up selectively by the afflicted tissue.

The polypeptides of the invention are administered by any route that delivers an effective dosage to the desired site of action. The determination of a suitable route of administration and an effective dosage for a particular indication is within the level of skill in the art. Preferably for wound treatment, one administers the therapeutic compound directly to the site. Suitable dosage ranges for the polypeptides of the invention can be extrapolated from these dosages or from similar studies in appropriate animal models. Dosages can then be adjusted as necessary by the clinician to provide maximal therapeutic benefit.

4.12.2 Compositions/Formulations

Pharmaceutical compositions for use in accordance with the present invention thus may be formulated in a conventional manner using one or more physiologically acceptable carriers comprising excipients and auxiliaries which facilitate processing of the active compounds into preparations which can be used pharmaceutically. These pharmaceutical compositions may be manufactured in a manner that is itself known, e.g., by means of conventional mixing, dissolving, granulating, dragee-making, levigating, emulsifying, encapsulating, entrapping or lyophilizing processes. Proper formulation is dependent upon the route of administration chosen. When a therapeutically effective amount of protein or other active ingredient of the present invention is administered orally, protein or other active ingredient of the present invention will be in the form of a tablet, capsule, powder, solution or elixir. When administered in tablet form, the pharmaceutical composition of the invention may additionally contain a solid carrier such as a gelatin or an adjuvant. The tablet, capsule, and powder contain from about 5 to 95% protein or other active ingredient of the present invention, and preferably from about 25 to 90% protein or other active ingredient of the present invention. When administered in liquid form, a liquid carrier such as water, petroleum, oils of animal or plant origin such as peanut oil, mineral oil, soybean oil, or sesame oil, or synthetic oils may be added. The liquid form of the pharmaceutical composition may further contain physiological saline solution, dextrose or other saccharide solution, or glycols such as ethylene glycol, propylene glycol or polyethylene glycol. When administered in liquid form, the pharmaceutical composition contains from about 0.5 to 90% by weight of protein or other active ingredient of the present invention, and preferably from about 1 to 50% protein or other active ingredient of the present invention.

When a therapeutically effective amount of protein or other active ingredient of the present invention is administered by intravenous, cutaneous or subcutaneous injection, protein or other active ingredient of the present invention will be in the form of a pyrogen-free, parenterally acceptable aqueous solution. The preparation of such parenterally acceptable protein or other active ingredient solutions, having due regard to pH, isotonicity, stability, and the like, is within the skill in the art. A preferred pharmaceutical composition for intravenous, cutaneous, or subcutaneous injection should contain, in addition to protein or other active ingredient of the present invention, an isotonic vehicle such as Sodium Chloride Injection, Ringer's Injection, Dextrose Injection, Dextrose and Sodium Chloride Injection, Lactated Ringer's Injection, or other vehicle as known in the art. The pharmaceutical composition of the present invention may also contain stabilizers, preservatives, buffers, antioxidants, or other additives known to those of skill in the art. For injection, the agents of the invention may be formulated in aqueous solutions, preferably in physiologically compatible buffers such as Hanks's solution, Ringer's solution, or physiological saline buffer. For transmucosal administration, penetrants appropriate to the barrier to be permeated are used in the formulation. Such penetrants are generally known in the art.

For oral administration, the compounds can be formulated readily by combining the active compounds with pharmaceutically acceptable carriers well known in the art. Such carriers enable the compounds of the invention to be formulated as tablets, pills, dragees, capsules, liquids, gels, syrups, slurries, suspensions and the like, for oral ingestion by a patient to be treated. Pharmaceutical preparations for oral use can be obtained from a solid excipient, optionally grinding a resulting mixture, and processing the mixture of granules, after adding suitable auxiliaries, if desired, to obtain tablets or dragee cores. Suitable excipients are, in particular, fillers such as sugars, including lactose, sucrose, mannitol, or sorbitol; cellulose preparations such as, for example, maize starch, wheat starch, rice starch, potato starch, gelatin, gum tragacanth, methyl cellulose, hydroxypropylmethyl-cellulose, sodium carboxymethylcellulose, and/or polyvinylpyrrolidone (PVP). If desired, disintegrating agents may be added, such as the cross-linked polyvinyl pyrrolidone, agar, or alginic acid or a salt thereof such as sodium alginate. Dragee cores are provided with suitable coatings. For this purpose, concentrated sugar solutions may be used, which may optionally contain gum arabic, talc, polyvinyl pyrrolidone, carbopol gel, polyethylene glycol, and/or titanium dioxide, lacquer solutions, and suitable organic solvents or solvent mixtures. Dyestuffs or pigments may be added to the tablets or dragee coatings for identification or to characterize different combinations of active compound doses.

Pharmaceutical preparations which can be used orally include push-fit capsules made of gelatin, as well as soft, sealed capsules made of gelatin and a plasticizer, such as glycerol or sorbitol. The push-fit capsules can contain the active ingredients in admixture with filler such as lactose, binders such as starches, and/or lubricants such as talc or magnesium stearate and, optionally, stabilizers. In soft capsules, the active compounds may be dissolved or suspended in suitable liquids, such as fatty oils, liquid paraffin, or liquid polyethylene glycols. In addition, stabilizers may be added. All formulations for oral administration should be in dosages suitable for such administration. For buccal administration, the compositions may take the form of tablets or lozenges formulated in conventional manner.

For administration by inhalation, the compounds for use according to the present invention are conveniently delivered in the form of an aerosol spray presentation from pressurized packs or a nebuliser, with the use of a suitable propellant, e.g., dichlorodifluoromethane, trichlorofluoromethane, dichlorotetrafluoroethane, carbon dioxide or other suitable gas. In the case of a pressurized aerosol the dosage unit may be determined by providing a valve to deliver a metered amount. Capsules and cartridges of, e.g., gelatin for use in an inhaler or insufflator may be formulated containing a powder mix of the compound and a suitable powder base such as lactose or starch. The compounds may be formulated for parenteral administration by injection, e.g., by bolus injection or continuous infusion. Formulations for injection may be presented in unit dosage form, e.g., in ampules or in multi-dose containers, with an added preservative. The compositions may take such forms as suspensions, solutions or emulsions in oily or aqueous vehicles, and may contain formulatory agents such as suspending, stabilizing and/or dispersing agents.

Pharmaceutical formulations for parenteral administration include aqueous solutions of the active compounds in water-soluble form. Additionally, suspensions of the active compounds may be prepared as appropriate oily injection suspensions. Suitable lipophilic solvents or vehicles include fatty oils such as sesame oil, or synthetic fatty acid esters, such as ethyl oleate or triglycerides, or liposomes. Aqueous injection suspensions may contain substances which increase the viscosity of the suspension, such as sodium carboxymethyl cellulose, sorbitol, or dextran. Optionally, the suspension may also contain suitable stabilizers or agents which increase the solubility of the compounds to allow for the preparation of highly concentrated solutions. Alternatively, the active ingredient may be in powder form for constitution with a suitable vehicle, e.g., sterile pyrogen-free water, before use.

The compounds may also be formulated in rectal compositions such as suppositories or retention enemas, e.g., containing conventional suppository bases such as cocoa butter or other glycerides. In addition to the formulations described previously, the compounds may also be formulated as a depot preparation. Such long acting formulations may be administered by implantation (for example subcutaneously or intramuscularly) or by intramuscular injection. Thus, for example, the compounds may be formulated with suitable polymeric or hydrophobic materials (for example as an emulsion in an acceptable oil) or ion exchange resins, or as sparingly soluble derivatives, for example, as a sparingly soluble salt.

A pharmaceutical carrier for the hydrophobic compounds of the invention is a co-solvent system comprising benzyl alcohol, a nonpolar surfactant, a water-miscible organic polymer, and an aqueous phase. The co-solvent system may be the VPD co-solvent system. VPD is a solution of 3% w/v benzyl alcohol, 8% w/v of the nonpolar surfactant polysorbate 80, and 65% w/v polyethylene glycol 300, made up to volume in absolute ethanol. The VPD co-solvent system (VPD:5W) consists of VPD diluted 1:1 with a 5% dextrose in water solution. This co-solvent system dissolves hydrophobic compounds well, and itself produces low toxicity upon systemic administration. Naturally, the proportions of a co-solvent system may be varied considerably without destroying its solubility and toxicity characteristics. Furthermore, the identity of the co-solvent components may be varied: for example, other low-toxicity nonpolar surfactants may be used instead of polysorbate 80; the fraction size of polyethylene glycol may be varied; other biocompatible polymers may replace polyethylene glycol, e.g. polyvinyl pyrrolidone; and other sugars or polysaccharides may substitute for dextrose. Alternatively, other delivery systems for hydrophobic pharmaceutical compounds may be employed. Liposomes and emulsions are well known examples of delivery vehicles or carriers for hydrophobic drugs. Certain organic solvents such as dimethylsulfoxide also may be employed, although usually at the cost of greater toxicity. Additionally, the compounds may be delivered using a sustained-release system, such as semipermeable matrices of solid hydrophobic polymers containing the therapeutic agent. Various types of sustained-release materials have been established and are well known by those skilled in the art. Sustained-release capsules may, depending on their chemical nature, release the compounds for a few weeks up to over 100 days. Depending on the chemical nature and the biological stability of the therapeutic reagent, additional strategies for protein or other active ingredient stabilization may be employed.

The pharmaceutical compositions also may comprise suitable solid or gel phase carriers or excipients. Examples of such carriers or excipients include but are not limited to calcium carbonate, calcium phosphate, various sugars, starches, cellulose derivatives, gelatin, and polymers such as polyethylene glycols. Many of the active ingredients of the invention may be provided as salts with pharmaceutically compatible counter ions. Such pharmaceutically acceptable base addition salts are those salts which retain the biological effectiveness and properties of the free acids and which are obtained by reaction with inorganic or organic bases such as sodium hydroxide, magnesium hydroxide, ammonia, trialkylamine, dialkylamine, monoalkylamine, dibasic amino acids, sodium acetate, potassium benzoate, triethanol amine and the like.

The pharmaceutical composition of the invention may be in the form of a complex of the protein(s) or other active ingredient(s) of present invention along with protein or peptide antigens. The protein and/or peptide antigen will deliver a stimulatory signal to both B and T lymphocytes. B lymphocytes will respond to antigen through their surface immunoglobulin receptor. T lymphocytes will respond to antigen through the T cell receptor (TCR) following presentation of the antigen by MHC proteins. MHC and structurally related proteins including those encoded by class I and class II MHC genes on host cells will serve to present the peptide antigen(s) to T lymphocytes. The antigen components could also be supplied as purified MHC-peptide complexes alone or with co-stimulatory molecules that can directly signal T cells. Alternatively antibodies able to bind surface immunoglobulin and other molecules on B cells as well as antibodies able to bind the TCR and other molecules on T cells can be combined with the pharmaceutical composition of the invention.

The pharmaceutical composition of the invention may be in the form of a liposome in which protein of the present invention is combined, in addition to other pharmaceutically acceptable carriers, with amphipathic agents such as lipids which exist in aggregated form as micelles, insoluble monolayers, liquid crystals, or lamellar layers in aqueous solution. Suitable lipids for liposomal formulation include, without limitation, monoglycerides, diglycerides, sulfatides, lysolecithins, phospholipids, saponin, bile acids, and the like. Preparation of such liposomal formulations is within the level of skill in the art, as disclosed, for example, in U.S. Pat. Nos. 4,235,871; 4,501,728; 4,837,028; and 4,737,323, all of which are incorporated herein by reference.

The amount of protein or other active ingredient of the present invention in the pharmaceutical composition of the present invention will depend upon the nature and severity of the condition being treated, and on the nature of prior treatments which the patient has undergone. Ultimately, the attending physician will decide the amount of protein or other active ingredient of the present invention with which to treat each individual patient. Initially, the attending physician will administer low doses of protein or other active ingredient of the present invention and observe the patient's response. Larger doses of protein or other active ingredient of the present invention may be administered until the optimal therapeutic effect is obtained for the patient, and at that point the dosage is not increased further. It is contemplated that the various pharmaceutical compositions used to practice the method of the present invention should contain about 0.01 μg to about 100 mg (preferably about 0.1 μg to about 10 mg, more preferably about 0.1 μg to about 1 mg) of protein or other active ingredient of the present invention per kg body weight. For compositions of the present invention which are useful for bone, cartilage, tendon or ligament regeneration, the therapeutic method includes administering the composition topically, systematically, or locally as an implant or device. When administered, the therapeutic composition for use in this invention is, of course, in a pyrogen-free, physiologically acceptable form. Further, the composition may desirably be encapsulated or injected in a viscous form for delivery to the site of bone, cartilage or tissue damage. Topical administration may be suitable for wound healing and tissue repair. Therapeutically useful agents other than a protein or other active ingredient of the invention which may also optionally be included in the composition as described above, may alternatively or additionally, be administered simultaneously or sequentially with the composition in the methods of the invention. Preferably for bone and/or cartilage formation, the composition would include a matrix capable of delivering the protein-containing or other active ingredient-containing composition to the site of bone and/or cartilage damage, providing a structure for the developing bone and cartilage and optimally capable of being resorbed into the body. Such matrices may be formed of materials presently in use for other implanted medical applications.

The choice of matrix material is based on biocompatibility, biodegradability, mechanical properties, cosmetic appearance and interface properties. The particular application of the compositions will define the appropriate formulation. Potential matrices for the compositions may be biodegradable and chemically defined calcium sulfate, tricalcium phosphate, hydroxyapatite, polylactic acid, polyglycolic acid and polyanhydrides. Other potential materials are biodegradable and biologically well-defined, such as bone or dermal collagen. Further matrices are comprised of pure proteins or extracellular matrix components. Other potential matrices are nonbiodegradable and chemically defined, such as sintered hydroxyapatite, bioglass, aluminates, or other ceramics. Matrices may be comprised of combinations of any of the above mentioned types of material, such as polylactic acid and hydroxyapatite or collagen and tricalcium phosphate. The bioceramics may be altered in composition, such as in calcium-aluminate-phosphate and processing to alter pore size, particle size, particle shape, and biodegradability. Presently preferred is a 50:50 (mole weight) copolymer of lactic acid and glycolic acid in the form of porous particles having diameters ranging from 150 to 800 microns. In some applications, it will be useful to utilize a sequestering agent, such as carboxymethyl cellulose or autologous blood clot, to prevent the protein compositions from disassociating from the matrix.

A preferred family of sequestering agents is cellulosic materials such as alkylcelluloses (including hydroxyalkylcelluloses), including methylcellulose, ethylcellulose, hydroxyethylcellulose, hydroxypropylcellulose, hydroxypropyl-methylcellulose, and carboxymethylcellulose, the most preferred being cationic salts of carboxymethylcellulose (CMC). Other preferred sequestering agents include hyaluronic acid, sodium alginate, poly(ethylene glycol), polyoxyethylene oxide, carboxyvinyl polymer and poly(vinyl alcohol). The amount of sequestering agent useful herein is 0.5–20 wt %, preferably 1–10 wt % based on total formulation weight, which represents the amount necessary to prevent desorption of the protein from the polymer matrix and to provide appropriate handling of the composition, yet not so much that the progenitor cells are prevented from infiltrating the matrix, thereby providing the protein the opportunity to assist the osteogenic activity of the progenitor cells. In further compositions, proteins or other active ingredients of the invention may be combined with other agents beneficial to the treatment of the bone and/or cartilage defect, wound, or tissue in question. These agents include various growth factors such as epidermal growth factor (EGF), platelet derived growth factor (PDGF), transforming growth factors (TGF-α and TGF-β), and insulin-like growth factor (IGF).

The therapeutic compositions are also presently valuable for veterinary applications. Particularly domestic animals and thoroughbred horses, in addition to humans, are desired patients for such treatment with proteins or other active ingredients of the present invention. The dosage regimen of a protein-containing pharmaceutical composition to be used in tissue regeneration will be determined by the attending physician considering various factors which modify the action of the proteins, e.g., amount of tissue weight desired to be formned, the site of damage, the condition of the damaged tissue, the size of a wound, type of damaged tissue (e.g., bone), the patient's age, sex, and diet, the severity of any infection, time of administration and other clinical factors. The dosage may vary with the type of matrix used in the reconstitution and with inclusion of other proteins in the pharmaceutical composition. For example, the addition of other known growth factors, such as IGF I (insulin like growth factor I), to the final composition, may also effect the dosage. Progress can be monitored by periodic assessment of tissue/bone growth and/or repair, for example, X-rays, histomorphometric determinations and tetracycline labeling.

Polynucleotides of the present invention can also be used for gene therapy. Such polynucleotides can be introduced either in vivo or ex vivo into cells for expression in a mammalian subject. Polynucleotides of the invention may also be administered by other known methods for introduction of nucleic acid into a cell or organism (including, without limitation, in the form of viral vectors or naked DNA). Cells may also be cultured ex vivo in the presence of proteins of the present invention in order to proliferate or to produce a desired effect on or activity in such cells. Treated cells can then be introduced in vivo for therapeutic purposes.

4.12.3 Effective Dosage

Pharmaceutical compositions suitable for use in the present invention include compositions wherein the active ingredients are contained in an effective amount to achieve its intended purpose. More specifically, a therapeutically effective amount means an amount effective to prevent development of or to alleviate the existing symptoms of the subject being treated. Determination of the effective amount is well within the capability of those skilled in the art, especially in light of the detailed disclosure provided herein. For any compound used in the method of the invention, the therapeutically effective dose can be estimated initially from appropriate in vitro assays. For example, a dose can be formulated in animal models to achieve a circulating concentration range that can be used to more accurately determine useful doses in humans. For example, a dose can be formulated in animal models to achieve a circulating concentration range that includes the $IC_{50}$ as determined in cell culture (i.e., the concentration of the test compound which achieves a half-maximal inhibition of the protein's biological activity). Such information can be used to more accurately determine useful doses in humans.

A therapeutically effective dose refers to that amount of the compound that results in amelioration of symptoms or a prolongation of survival in a patient. Toxicity and therapeutic efficacy of such compounds can be determined by standard pharmaceutical procedures in cell cultures or experimental animals, e.g., for determining the $LD_{50}$ (the dose lethal to 50% of the population) and the $ED_{50}$ (the dose therapeutically effective in 50% of the population). The dose ratio between toxic and therapeutic effects is the therapeutic index and it can be expressed as the ratio between $LD_{50}$ and $ED_{50}$. Compounds which exhibit high therapeutic indices are preferred. The data obtained from these cell culture assays and animal studies can be used in formulating a range of dosage for use in human. The dosage of such compounds lies preferably within a range of circulating concentrations that include the $ED_{50}$ with little or no toxicity. The dosage may vary within this range depending upon the dosage form employed and the route of administration utilized. The exact formulation, route of administration and dosage can be chosen by the individual physician in view of the patient's condition. See, e.g. Fingl et al., 1975, in "The Pharmacological Basis of Therapeutics", Ch. 1 p. 1. Dosage amount and interval may be adjusted individually to provide plasma levels of the active moiety which are sufficient to maintain the desired effects, or minimal effective concentration (MEC). The MEC will vary for each compound but can be estimated from in vitro data. Dosages necessary to achieve the MEC will depend on individual characteristics and route of administration. However, HPLC assays or bioassays can be used to determine plasma concentrations.

Dosage intervals can also be determined using MEC value. Compounds should be administered using a regimen which maintains plasma levels above the MEC for 10–90% of the time, preferably between 30–90% and most preferably between 50–90%. In cases of local administration or selective uptake, the effective local concentration of the drug may not be related to plasma concentration.

An exemplary dosage regimen for polypeptides or other compositions of the invention will be in the range of about 0.01 µg/kg to 100 mg/kg of body weight daily, with the preferred dose being about 0.1 µg/kg to 25 mg/kg of patient body weight daily, varying in adults and children. Dosing may be once daily, or equivalent doses may be delivered at longer or shorter intervals.

The amount of composition administered will, of course, be dependent on the subject being treated, on the subject's age and weight, the severity of the affliction, the manner of administration and the judgment of the prescribing physician.

4.12.4 Packaging

The compositions may, if desired, be presented in a pack or dispenser device which may contain one or more unit dosage forms containing the active ingredient. The pack may, for example, comprise metal or plastic foil, such as a blister pack. The pack or dispenser device may be accompanied by instructions for administration. Compositions comprising a compound of the invention formulated in a compatible pharmaceutical carrier may also be prepared, placed in an appropriate container, and labeled for treatment of an indicated condition.

4.13 Antibodies

Also included in the invention are antibodies to proteins, or fragments of proteins of the invention. The term "antibody" as used herein refers to immnunoglobulin molecules and immunologically active portions of immunoglobulin (Ig) molecules, i.e., molecules that contain an antigen-binding site that specifically binds (immunoreacts with) an antigen. Such antibodies include, but are not limited to, polyclonal, monoclonal, chimeric, single chain, $F_{ab}$, $F_{ab'}$ and $F_{(ab')2}$ fragments, and an $F_{ab}$ expression library. In general, an antibody molecule obtained from humans relates to any of the classes IgG, IgM, IgA, IgE and IgD, which differ from one another by the nature of the heavy chain present in the molecule. Certain classes have subclasses as well, such as $IgG_1$, $IgG_2$, and others. Furthermore, in humans, the light chain may be a kappa chain or a lambda chain. Reference herein to antibodies includes a reference to all such classes, subclasses and types of human antibody species.

An isolated related protein of the invention may be intended to serve as an antigen, or a portion or fragment thereof, and additionally can be used as an immunogen to generate antibodies that immunospecifically bind the antigen, using standard techniques for polyclonal and monoclonal antibody preparation. The full-length protein can be used or, alternatively, the invention provides antigenic peptide fragments of the antigen for use as immunogens. An antigenic peptide fragment comprises at least 6 amino acid residues of the amino acid sequence of the full length protein, such as an amino acid sequence shown in SEQ ID NO: 1–441, and encompasses an epitope thereof such that an antibody raised against the peptide forms a specific immune complex with the full length protein or with any fragment that contains the epitope. Preferably, the antigenic peptide comprises at least 10 amino acid residues, or at least 15 amino acid residues, or at least 20 amino acid residues, or at least 30 amino acid residues. Preferred epitopes encompassed by the antigenic peptide are regions of the protein that are located on its surface; commonly these are hydrophilic regions.

In certain embodiments of the invention, at least one epitope encompassed by the antigenic peptide is a region of alpha-2-macroglobulin-like protein that is located on the surface of the protein, e.g., a hydrophilic region. A hydrophobicity analysis of the human related protein sequence will indicate which regions of a related protein are particularly hydrophilic and, therefore, are likely to encode surface residues useful for targeting antibody production. As a means for targeting antibody production, hydropathy plots showing regions of hydrophilicity and hydrophobicity may be generated by any method well known in the art, including, for example, the Kyte Doolittle or the Hopp Woods methods, either with or without Fourier transformation. See, e.g., Hopp and Woods, 1981, *Proc. Nat. Acad. Sci. USA* 78: 3824–3828; Kyte and Doolittle 1982, *J. Mol. Biol.* 157: 105–142, each of which is incorporated herein by reference in its entirety. Antibodies that are specific for one or more domains within an antigenic protein, or derivatives, fragments, analogs or homologs thereof, are also provided herein.

A protein of the invention, or a derivative, fragment, analog, homolog or ortholog thereof, may be utilized as an immunogen in the generation of antibodies that immunospecifically bind these protein components.

The term "specific for" indicates that the variable regions of the antibodies of the invention recognize and bind polypeptides of the invention exclusively (i.e., able to distinguish the polypeptide of the invention from other similar polypeptides despite sequence identity, homology, or similarity found in the family of polypeptides), but may also interact with other proteins (for example, *S. aureus* protein A or other antibodies in ELISA techniques) through interactions with sequences outside the variable region of the antibodies, and in particular, in the constant region of the molecule. Screening assays to determine binding specificity of an antibody of the invention are well known and routinely practiced in the art. For a comprehensive discussion of such assays, see Harlow et al. (Eds), Antibodies A Laboratory Manual; Cold Spring Harbor Laboratory; Cold Spring Harbor, N.Y. (1988), Chapter 6. Antibodies that recognize and bind fragments of the polypeptides of the invention are also contemplated, provided that the antibodies are first and foremost specific for, as defined above, full-length polypeptides of the invention. As with antibodies that are specific for full length polypeptides of the invention, antibodies of the invention that recognize fragments are those which can distinguish polypeptides from the same family of polypeptides despite inherent sequence identity, homology, or similarity found in the family of proteins.

Antibodies of the invention are useful for, for example, therapeutic purposes (by modulating activity of a polypeptide of the invention), diagnostic purposes to detect or quantitate a polypeptide of the invention, as well as purification of a polypeptide of the invention. Kits comprising an antibody of the invention for any of the purposes described herein are also comprehended. In general, a kit of the invention also includes a control antigen for which the antibody is immunospecific. The invention further provides a hybridoma that produces an antibody according to the invention. Antibodies of the invention are useful for detection and/or purification of the polypeptides of the invention.

Monoclonal antibodies binding to the protein of the invention may be useful diagnostic agents for the immunodetection of the protein. Neutralizing monoclonal antibodies binding to the protein may also be useful therapeutics for both conditions associated with the protein and also in the treatment of some forms of cancer where abnormal expression of the protein is involved. In the case of cancerous cells or leukemic cells, neutralizing monoclonal antibodies against the protein may be useful in detecting and preventing the metastatic spread of the cancerous cells, which may be mediated by the protein.

The labeled antibodies of the present invention can be used for in vitro, in vivo, and in situ assays to identify cells or tissues in which a fragment of the polypeptide of interest is expressed. The antibodies may also be used directly in therapies or other diagnostics. The present invention further provides the above-described antibodies immobilized on a solid support. Examples of such solid supports include plastics such as polycarbonate, complex carbohydrates such as agarose and Sepharose®, acrylic resins and such as polyacrylamide and latex beads. Techniques for coupling antibodies to such solid supports are well known in the art (Weir, D. M. et al., "Handbook of Experimental Immunology" 4th Ed., Blackwell Scientific Publications, Oxford, England, Chapter 10 (1986); Jacoby, W. D. et al., Meth. Enzym. 34 Academic Press, N.Y. (1974)). The immobilized antibodies of the present invention can be used for in vitro, in vivo, and in situ assays as well as for immuno-affinity purification of the proteins of the present invention.

Various procedures known within the art may be used for the production of polyclonal or monoclonal antibodies directed against a protein of the invention, or against derivatives, fragments, analogs homologs or orthologs thereof (see, for example, Antibodies: A Laboratory Manual, Harlow E, and Lane D, 1988, Cold Spring Harbor Laboratory Press, Cold Spring Harbor, N.Y., incorporated herein by reference). Some of these antibodies are discussed below.

4.13.1 Polyclonal Antibodies

For the production of polyclonal antibodies, various suitable host animals (e.g., rabbit, goat, mouse or other mammal) may be immunized by one or more injections with the native protein, a synthetic variant thereof, or a derivative of the foregoing. An appropriate immunogenic preparation can contain, for example, the naturally occurring immunogenic protein, a chemically synthesized polypeptide representing the immunogenic protein, or a recombinantly expressed immunogenic protein. Furthermore, the protein may be conjugated to a second protein known to be immunogenic in the mammal being immunized. Examples of such immunogenic proteins include but are not limited to keyhole limpet hemocyanin, serum albumin, bovine thyroglobulin, and soybean trypsin inhibitor. The preparation can further include an adjuvant. Various adjuvants used to increase the immunological response include, but are not limited to, Freund's (complete and incomplete), mineral gels (e.g., aluminum hydroxide), surface-active substances (e.g., lysolecithin, pluronic polyols, polyanions, peptides, oil emulsions, dinitrophenol, etc.), adjuvants usable in humans such as Bacille Calmette-Guerin and Corynebacterium parvum, or similar immunostimulatory agents. Additional examples of adjuvants that can be employed include MPL-TDM adjuvant (monophosphoryl Lipid A, synthetic trehalose dicorynomycolate).

The polyclonal antibody molecules directed against the immunogenic protein can be isolated from the mammal (e.g., from the blood) and further purified by well known techniques, such as affinity chromatography using protein A or protein G, which provide primarily the IgG fraction of immune serum. Subsequently, or alternatively, the specific antigen which is the target of the immunoglobulin sought, or an epitope thereof, may be immobilized on a column to purify the immune specific antibody by immunoaffinity chromatography. Purification of immunoglobulins is discussed, for example, by D. Wilkinson (The Scientist, published by The Scientist, Inc., Philadelphia Pa., Vol. 14, No. 8 (Apr. 17, 2000), pp. 25–28).

4.13.2 Monoclonal Antibodies

The term "monoclonal antibody" (MAb) or "monoclonal antibody composition", as used herein, refers to a population of antibody molecules that contain only one molecular species of antibody molecule consisting of a unique light chain gene product and a unique heavy chain gene product. In particular, the complementarity determining regions (CDRs) of the monoclonal antibody are identical in all the molecules of the population. MAbs thus contain an antigen-binding site capable of immunoreacting with a particular epitope of the antigen characterized by a unique binding affinity for it.

Monoclonal antibodies can be prepared using hybridoma methods, such as those described by Kohler and Milstein, Nature, 256:495 (1975). In a hybridoma method, a mouse, hamster, or other appropriate host animal, is typically immunized with an immunizing agent to elicit lymphocytes that produce or are capable of producing antibodies that will specifically bind to the immunizing agent. Alternatively, the lymphocytes can be immunized in vitro.

The immunizing agent will typically include the protein antigen, a fragment thereof or a fusion protein thereof. Generally, either peripheral blood lymphocytes are used if cells of human origin are desired, or spleen cells or lymph node cells are used if non-human mammalian sources are desired. The lymphocytes are then fused with an immortalized cell line using a suitable fusing agent, such as polyethylene glycol, to form a hybridoma cell (Goding, Monoclonal Antibodies: Principles and Practice, Academic Press, (1986) pp. 59–103). Immortalized cell lines are usually transformed mammalian cells, particularly myeloma cells of rodent, bovine and human origin. Usually, rat or mouse myeloma cell lines are employed. The hybridoma cells can be cultured in a suitable culture medium that preferably contains one or more substances that inhibit the growth or survival of the unfused, immortalized cells. For example, if the parental cells lack the enzyme hypoxanthine guanine phosphoribosyl transferase (HGPRT or HPRT), the culture medium for the hybridomas typically will include hypoxanthine, aminopterin, and thymidine ("HAT medium"), which substances prevent the growth of HGPRT-deficient cells.

Preferred immortalized cell lines are those that fuse efficiently, support stable high level expression of antibody by the selected antibody-producing cells, and are sensitive to a medium such as HAT medium. More preferred immortalized cell lines are murine myeloma lines, which can be obtained, for instance, from the Salk Institute Cell Distribution Center, San Diego, Calif. and the American Type Culture Collection, Manassas, Va. Human myeloma and mouse-human heteromyeloma cell lines also have been described for the production of human monoclonal antibodies (Kozbor, J. Immunol., 133:3001 (1984); Brodeur et al., *Monoclonal Antibody Production Techniques and Applications,* Marcel Dekker, Inc., New York, (1987) pp. 51–63).

The culture medium in which the hybridoma cells are cultured can then be assayed for the presence of monoclonal antibodies directed against the antigen. Preferably, the binding specificity of monoclonal antibodies produced by the hybridoma cells is determined by immunoprecipitation or by an in vitro binding assay, such as radioimmunoassay (RIA) or enzyme-linked immunoabsorbent assay (ELISA). Such techniques and assays are known in the art. The binding affinity of the monoclonal antibody can, for example, be determined by the Scatchard analysis of Munson and Pollard, *Anal. Biochem.,* 107:220 (1980). Preferably, antibodies having a high degree of specificity and a high binding affinity for the target antigen are isolated.

After the desired hybridoma cells are identified, the clones can be subcloned by limiting dilution procedures and grown by standard methods. Suitable culture media for this purpose include, for example, Dulbecco's Modified Eagle's Medium and RPMI-1640 medium. Alternatively, the hybridoma cells can be grown in vivo as as cites in a mammal.

The monoclonal antibodies secreted by the subcloned can be isolated or purified from the culture medium or as cites fluid by conventional immunoglobulin purification procedures such as, for example, protein A-Sepharose, hydroxylapatite chromatography, gel electrophoresis, dialysis, or affinity chromatography.

The monoclonal antibodies can also be made by recombinant DNA methods, such as those described in U.S. Pat. No. 4,816,567. DNA encoding the monoclonal antibodies of the invention can be readily isolated and sequenced using conventional procedures (e.g., by using oligonucleotide probes that are capable of binding specifically to genes encoding the heavy and light chains of murine antibodies). The hybridoma cells of the invention serve as a preferred source of such DNA. Once isolated, the DNA can be placed into expression vectors, which are then transfected into host cells such as simian COS cells, Chinese hamster ovary (CHO) cells, or myeloma cells that do not otherwise produce immunoglobulin protein, to obtain the synthesis of monoclonal antibodies in the recombinant host cells. The DNA also can be modified, for example, by substituting the coding sequence for human heavy and light chain constant domains in place of the homologous murine sequences (U.S. Pat. No. 4,816,567; Morrison, *Nature* 368, 812–13 (1994)) or by covalently joining to the immunoglobulin coding sequence all or part of the coding sequence for a non-immunoglobulin polypeptide. Such a non-immunoglobulin polypeptide can be substituted for the constant domains of an antibody of the invention, or can be substituted for the variable domains of one antigen-combining site of an antibody of the invention to create a chimeric bivalent antibody.

4.13.3 Humanized Antibodies

The antibodies directed against the protein antigens of the invention can further comprise humanized antibodies or human antibodies. These antibodies are suitable for administration to humans without engendering an immune response by the human against the administered immunoglobulin. Humanized forms of antibodies are chimeric immunoglobulins, immunoglobulin chains or fragments thereof (such as Fv, Fab, Fab', F(ab')$_2$ or other antigen-binding subsequences of antibodies) that are principally comprised of the sequence of a human immunoglobulin, and contain minimal sequence derived from a non-human immunoglobulin. Humanization can be performed following the method of Winter and co-workers (Jones et al., *Nature,* 321:522–525 (1986); Riechmann et al., *Nature,* 332:323–327 (1988); Verhoeyen et al., *Science,* 239:1534–1536 (1988)), by substituting rodent CDRs or CDR sequences for the corresponding sequences of a human antibody. (See also U.S. Pat. No. 5,225,539). In some instances, Fv framework residues of the human immunoglobulin are replaced by corresponding non-human residues. Humanized antibodies can also comprise residues that are found neither in the recipient antibody nor in the imported CDR or framework sequences. In general, the humanized antibody will comprise substantially all of at least one, and typically two, variable domains, in which all or substantially all of the CDR regions correspond to those of a non-human immnunoglobulin and all or substantially all of the framework regions are those of a human immunoglobulin consensus sequence. The humanized antibody optimally also will comprise at least a portion of an immunoglobulin constant region (Fc), typically that of a human immunoglobulin (Jones et al., 1986; Riechmann et al., 1988; and Presta, *Curr. Op. Struct. Biol.,* 2:593–596 (1992)).

4.13.4 Human Antibodies

Fully human antibodies relate to antibody molecules in which essentially the entire sequences of both the light chain and the heavy chain, including the CDRs, arise from human genes. Such antibodies are termed "human antibodies", or "fully human antibodies" herein. Human monoclonal antibodies can be prepared by the trioma technique; the human B-cell hybridoma technique (see Kozbor, et al., 1983 Immunol Today 4: 72) and the EBV hybridoma technique to produce human monoclonal antibodies (see Cole, et al., 1985 In: MONOCLONAL ANTIBODIES AND CANCER THERAPY, Alan R. Liss, Inc., pp. 77–96). Human monoclonal antibodies may be utilized in the practice of the present invention and may be produced by using human hybridomas (see Cote, et al., 1983. Proc Natl Acad Sci USA 80: 2026–2030) or by transforming human B-cells with Epstein Barr Virus in vitro (see Cole, et al., 1985 In: MONOCLONAL ANTIBODIES AND CANCER THERAPY, Alan R. Liss, Inc., pp. 77–96).

In addition, human antibodies can also be produced using additional techniques, including phage display libraries (Hoogenboom and Winter, *J. Mol. Biol.,* 227:381 (1991); Marks et al., *J. Mol. Biol.,* 222:581 (1991)). Similarly, human antibodies can be made by introducing human immunoglobulin loci into transgenic animals, e.g., mice in which the endogenous immunoglobulin genes have been partially or completely inactivated. Upon challenge, human antibody production is observed, which closely resembles that seen in humans in all respects, including gene rearrangement, assembly, and antibody repertoire. This approach is described, for example, in U.S. Pat. Nos. 5,545,807; 5,545, 806; 5,569,825; 5,625,126; 5,633,425; 5,661,016, and in Marks et al. (*Bio/Technology* 10, 779–783 (1992)); Lonberg et al. (*Nature* 368 856–859 (1994)); Morrison (*Nature* 368, 812–13 (1994)); Fishwild et al, (*Nature Biotechnology* 14, 845–51 (1996)); Neuberger (*Nature Biotechnology* 14, 826 (1996)); and Lonberg and Huszar (*Intern. Rev. Immunol.* 13 65–93 (1995)).

Human antibodies may additionally be produced using transgenic nonhuman animals that are modified so as to produce fully human antibodies rather than the animal's endogenous antibodies in response to challenge by an antigen. (See PCT publication WO94/02602). The endogenous genes encoding the heavy and light immunoglobulin chains in the nonhuman host have been incapacitated, and active loci encoding human heavy and light chain immunoglobulins are inserted into the host's genome. The human genes are incorporated, for example, using yeast artificial chromosomes containing the requisite human DNA segments. An animal which provides all the desired modifications is then obtained as progeny by crossbreeding intermediate transgenic animals containing fewer than the full complement of the modifications. The preferred embodiment of such a nonhuman animal is a mouse, and is termed the Xenomouse™ as disclosed in PCT publications WO 96/33735 and WO 96/34096. This animal produces B cells that secrete fully human immunoglobulins. The antibodies can be obtained directly from the animal after immunization with an immunogen of interest, as, for example, a preparation of a polyclonal antibody, or alternatively from immortalized B cells derived from the animal, such as hybridomas producing monoclonal antibodies. Additionally, the genes encoding the immunoglobulins with human variable regions can be recovered and expressed to obtain the antibodies directly, or can be further modified to obtain analogs of antibodies such as, for example, single chain Fv molecules.

An example of a method of producing a nonhuman host, exemplified as a mouse, lacking expression of an endogenous immunoglobulin heavy chain is disclosed in U.S. Pat. No. 5,939,598. It can be obtained by a method including deleting the J segment genes from at least one endogenous heavy chain locus in an embryonic stem cell to prevent rearrangement of the locus and to prevent formation of a transcript of a rearranged immunoglobulin heavy chain locus, the deletion being effected by a targeting vector containing a gene encoding a selectable marker; and producing from the embryonic stem cell a transgenic mouse whose somatic and germ cells contain the gene encoding the selectable marker.

A method for producing an antibody of interest, such as a human antibody, is disclosed in U.S. Pat. No. 5,916,771. It includes introducing an expression vector that contains a nucleotide sequence encoding a heavy chain into one mammalian host cell in culture, introducing an expression vector containing a nucleotide sequence encoding a light chain into another mammalian host cell, and fusing the two cells to form a hybrid cell. The hybrid cell expresses an antibody containing the heavy chain and the light chain.

In a further improvement on this procedure, a method for identifying a clinically relevant epitope on an immunogen, and a correlative method for selecting an antibody that binds immunospecifically to the relevant epitope with high affinity, are disclosed in PCT publication WO 99/53049.

4.13.5 Fab Fragments and Single Chain Antibodies

According to the invention, techniques can be adapted for the production of single-chain antibodies specific to an antigenic protein of the invention (see e.g., U.S. Pat. No. 4,946,778). In addition, methods can be adapted for the construction of $F_{ab}$ expression libraries (see e.g., Huse, et al., 1989 Science 246: 1275–1281) to allow rapid and effective identification of monoclonal $F_{ab}$ fragments with the desired specificity for a protein or derivatives, fragments, analogs or homologs thereof. Antibody fragments that contain the idiotypes to a protein antigen may be produced by techniques known in the art including, but not limited to: (i) an $F_{(ab')2}$ fragment produced by pepsin digestion of an antibody molecule; (ii) an $F_{ab}$ fragment generated by reducing the disulfide bridges of an $F_{(ab')2}$ fragment; (iii) an $F_{ab}$ fragment generated by the treatment of the antibody molecule with papain and a reducing agent and (iv) $F_v$ fragments.

4.13.6 Bispecific Antibodies

Bispecific antibodies are monoclonal, preferably human or humanized, antibodies that have binding specificities for at least two different antigens. In the present case, one of the binding specificities is for an antigenic protein of the invention. The second binding target is any other antigen, and advantageously is a cell-surface protein or receptor or receptor subunit.

Methods for making bispecific antibodies are known in the art. Traditionally, the recombinant production of bispecific antibodies is based on the co-expression of two immunoglobulin heavy-chain/light-chain pairs, where the two heavy chains have different specificities (Milstein and Cuello, Nature, 305:537–539 (1983)). Because of the random assortment of immunoglobulin heavy and light chains, these hybridomas (quadromas) produce a potential mixture of ten different antibody molecules, of which only one has the correct bispecific structure. The purification of the correct molecule is usually accomplished by affinity chromatography steps. Similar procedures are disclosed in WO 93/08829, published May 13, 1993, and in Traunecker et al., 1991 EMBO J., 10:3655–3659.

Antibody variable domains with the desired binding specificities (antibody-antigen combining sites) can be fused to immunoglobulin constant domain sequences. The fusion preferably is with an immunoglobulin heavy-chain constant domain, comprising at least part of the hinge, CH2, and CH3 regions. It is preferred to have the first heavy-chain constant region (CH1) containing the site necessary for light-chain binding present in at least one of the fusions. DNAs encoding the immunoglobulin heavy-chain fusions and, if desired, the immunoglobulin light chain, are inserted into separate expression vectors, and are co-transfected into a suitable host organism. For further details of generating bispecific antibodies see, for example, Suresh et al., Methods in Enzymology, 121:210 (1986).

According to another approach described in WO 96/27011, the interface between a pair of antibody molecules can be engineered to maximize the percentage of heterodimers that are recovered from recombinant cell culture. The preferred interface comprises at least a part of the CH3 region of an antibody constant domain. In this method, one or more small amino acid side chains from the interface of the first antibody molecule are replaced with larger side chains (e.g. tyrosine or tryptophan). Compensatory "cavities" of identical or similar size to the large side chain(s) are created on the interface of the second antibody molecule by replacing large amino acid side chains with smaller ones (e.g. alanine or threonine). This provides a mechanism for increasing the yield of the heterodimer over other unwanted end-products such as homodimers.

Bispecific antibodies can be prepared as full length antibodies or antibody fragments (e.g. F(ab')$_2$ bispecific antibodies). Techniques for generating bispecific antibodies from antibody fragments have been described in the literature. For example, bispecific antibodies can be prepared using chemical linkage. Brennan et al., Science 229:81 (1985) describe a procedure wherein intact antibodies are proteolytically cleaved to generate F(ab')$_2$ fragments. These fragments are reduced in the presence of the dithiol complexing agent sodium arsenite to stabilize vicinal dithiols and prevent intermolecular disulfide formation. The Fab' fragments generated are then converted to thionitrobenzoate (TN1B) derivatives. One of the Fab'-TNB derivatives is then reconverted to the Fab'-thiol by reduction with mercaptoethylamine and is mixed with an equimolar amount of the other Fab'-TNB derivative to form the bispecific antibody. The bispecific antibodies produced can be used as agents for the selective immobilization of enzymes.

Additionally, Fab' fragments can be directly recovered from E. coli and chemically coupled to form bispecific antibodies. Shalaby et al., J. Exp. Med. 175:217–225 (1992) describe the production of a fully humanized bispecific antibody F(ab')$_2$ molecule. Each Fab' fragment was separately secreted from E. coli and subjected to directed chemical coupling in vitro to form the bispecific antibody. The bispecific antibody thus formed was able to bind to cells overexpressing the ErbB2 receptor and normal human T cells, as well as trigger the lytic activity of human cytotoxic lymphocytes against human breast tumor targets.

Various techniques for making and isolating bispecific antibody fragments directly from recombinant cell culture have also been described. For example, bispecific antibodies have been produced using leucine zippers. Kostelny et al., J. Immunol. 148(5): 1547–1553 (1992). The leucine zipper peptides from the Fos and Jun proteins were linked to the Fab' portions of two different antibodies by gene fusion. The antibody homodimers were reduced at the hinge region to form monomers and then re-oxidized to form the antibody heterodimers. This method can also be utilized for the production of antibody homodimers. The "diabody" technology described by Hollinger et al., Proc. Natl. Acad. Sci. USA 90:6444–6448 (1993) has provided an alternative mechanism for making bispecific antibody fragments. The fragments comprise a heavy-chain variable domain ($V_H$) connected to a light-chain variable domain ($V_L$) by a linker which is too short to allow pairing between the two domains on the same chain. Accordingly, the $V_H$ and $V_L$ domains of one fragment are forced to pair with the complementary $V_L$ and $V_H$ domains of another fragment, thereby forming two antigen-binding sites. Another strategy for making bispecific antibody fragments by the use of single-chain Fv (sFv) dimers has also been reported. See, Gruber et al., J. Immunol. 152:5368 (1994).

Antibodies with more than two valencies are contemplated. For example, trispecific antibodies can be prepared. Tutt et al., J. Immunol. 147:60 (1991).

Exemplary bispecific antibodies can bind to two different epitopes, at least one of which originates in the protein antigen of the invention. Alternatively, an anti-antigenic arm of an immunoglobulin molecule can be combined with an arm which binds to a triggering molecule on a leukocyte such as a T-cell receptor molecule (e.g. CD2, CD3, CD28, or B7), or Fc receptors for IgG (FcγR), such as FcγRf (CD64), FcγRII (CD32) and FcγRIII (CD16) so as to focus cellular defense mechanisms to the cell expressing the particular antigen. Bispecific antibodies can also be used to direct cytotoxic agents to cells which express a particular antigen. These antibodies possess an antigen-binding arm and an arm which binds a cytotoxic agent or a radionuclide chelator, such as EOTUBE, DPTA, DOTA, or TETA. Another bispecific antibody of interest binds the protein antigen described herein and further binds tissue factor (TF).

4.13.7 Heteroconjugate Antibodies

Heteroconjugate antibodies are also within the scope of the present invention. Heteroconjugate antibodies are composed of two covalently joined antibodies. Such antibodies have, for example, been proposed to target immune system cells to unwanted cells (U.S. Pat. No. 4,676,980), and for treatment of HIV infection (WO 91/00360; WO 92/200373; EP 03089). It is contemplated that the antibodies can be prepared in vitro using known methods in synthetic protein chemistry, including those involving crosslinking agents. For example, immunotoxins can be constructed using a disulfide exchange reaction or by forming a thioether bond. Examples of suitable reagents for this purpose include iminothiolate and methyl-4-mercaptobutyrimidate and those disclosed, for example, in U.S. Pat. No. 4,676,980.

4.13.8 Effector Function Engineering

It can be desirable to modify the antibody of the invention with respect to effector function, so as to enhance, e.g., the effectiveness of the antibody in treating cancer. For example, cysteine residue(s) can be introduced into the Fc region, thereby allowing interchain disulfide bond formation in this region. The homodimeric antibody thus generated can have improved internalization capability and/or increased complement-mediated cell killing and antibody-dependent cellular cytotoxicity (ADCC). See Caron et al., J. Exp Med., 176: 1191–1195 (1992) and Shopes, J. Immunol., 148: 2918–2922 (1992). Homodimeric antibodies with enhanced anti-tumor activity can also be prepared using heterobifunctional cross-linkers as described in Wolff et al. Cancer Research, 53: 2560–2565 (1993). Alternatively, an antibody can be engineered that has dual Fc regions and can thereby have enhanced complement lysis and ADCC capabilities. See Stevenson et al., Anti-Cancer Drug Design, 3: 219–230 (1989).

4.13.9 Immunoconjugates

The invention also pertains to immunoconjugates comprising an antibody conjugated to a cytotoxic agent such as a chemotherapeutic agent, toxin (e.g., an enzymatically active toxin of bacterial, fungal, plant, or animal origin, or fragments thereof), or a radioactive isotope (i.e., a radioconjugate).

Chemotherapeutic agents useful in the generation of such immunoconjugates have been described above. Enzymatically active toxins and fragments thereof that can be used include diphtheria A chain, nonbinding active fragments of diphtheria toxin, exotoxin A chain (from Pseudomonas aeruginosa), ricin A chain, abrin A chain, modeccin A chain, alpha-sarcin, Aleurites fordii proteins, dianthin proteins, Phytolaca americana proteins (PAPI, PAPII, and PAP-S), momordica charantia inhibitor, curcin, crotin, sapaonaria officinalis inhibitor, gelonin, mitogellin, restrictocin, phenomycin, enomycin, and the tricothecenes. A variety of radionuclides are available for the production of radioconjugated antibodies. Examples include $^{212}$Bi, $^{131}$I, $^{131}$In, $^{90}$Y, and $^{186}$Re.

Conjugates of the antibody and cytotoxic agent are made using a variety of bifunctional protein-coupling agents such as N-succinimidyl-3-(2-pyridyldithiol)propionate (SPDP), iminothiolane (IT), bifunctional derivatives of imidoesters (such as dimethyl adipimidate HCL), active esters (such as disuccinimidyl suberate), aldehydes (such as glutareldehyde), bis-azido compounds (such as bis p-azidobenzoyl)hexanediamine), bis-diazonium derivatives (such as bis-(p-diazoniumbenzoyl)-ethylenediamine), diisocyanates (such as tolyene 2,6-diisocyanate), and bis-active fluorine compounds (such as 1,5-difluoro-2,4-dinitrobenzene). For example, a ricin immunotoxin can be prepared as described in Vitetta et al., Science, 238: 1098 (1987). Carbon-14-labeled 1-isothiocyanatobenzyl-3- methyldiethylene triaminepentaacetic acid (MX-DTPA) is an exemplary chelating agent for conjugation of radionucleotide to the antibody. See WO94/11026.

In another embodiment, the antibody can be conjugated to a "receptor" (such streptavidin) for utilization in tumor pretargeting wherein the antibody-receptor conjugate is administered to the patient, followed by removal of unbound conjugate from the circulation using a clearing agent and then administration of a "ligand" (e.g., avidin) that is in turn conjugated to a cytotoxic agent.

4.14 Computer Readable Sequences

In one application of this embodiment, a nucleotide sequence of the present invention can be recorded on computer readable media. As used herein, "computer readable media" refers to any medium which can be read and accessed directly by a computer. Such media include, but are not limited to: magnetic storage media, such as floppy discs, hard disc storage medium, and magnetic tape; optical storage media such as CD-ROM; electrical storage media such as RAM and ROM; and hybrids of these categories such as magnetic/optical storage media. A skilled artisan can readily appreciate how any of the presently known computer readable mediums can be used to create a manufacture comprising computer readable medium having recorded thereon a nucleotide sequence of the present invention. As used herein, "recorded" refers to a process for storing information on computer readable medium. A skilled artisan can readily adopt any of the presently known methods for recording information on computer readable medium to generate manufactures comprising the nucleotide sequence information of the present invention.

A variety of data storage structures are available to a skilled artisan for creating a computer readable medium having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable medium. The sequence information can be represented in a word processing text file, formatted in commercially-available software such as WordPerfect and Microsoft Word, or represented in the form of an ASCII file, stored in a database application, such as DB2, Sybase, Oracle, or the like. A skilled artisan can readily adapt any number of data processor structuring formats (e.g. text file or database) in order to obtain computer readable medium having recorded thereon the nucleotide sequence information of the present invention.

By providing any of the nucleotide sequences SEQ ID NOs: 1–441 or a representative fragment thereof; or a nucleotide sequence at least 95% identical to any of the nucleotide sequences of SEQ ID NOs: 1–441 in computer readable form, a skilled artisan can routinely access the sequence information for a variety of purposes. Computer software is publicly available which allows a skilled artisan to access sequence information provided in a computer readable medium. The examples which follow demonstrate how software which implements the BLAST (Altschul et al., J. Mol. Biol. 215:403–410 (1990)) and BLAZE (Brutlag et al., Comp. Chem. 17:203–207 (1993)) search algorithms on a Sybase system is used to identify open reading frames (ORFs) within a nucleic acid sequence. Such ORFs may be protein encoding fragments and may be useful in producing commercially important proteins such as enzymes used in fermentation reactions and in the production of commercially useful metabolites.

As used herein, "a computer-based system" refers to the hardware means, software means, and data storage means used to analyze the nucleotide sequence information of the present invention. The minimum hardware means of the computer-based systems of the present invention comprises a central processing unit (CPU), input means, output means, and data storage means. A skilled artisan can readily appreciate that any one of the currently available computer-based systems are suitable for use in the present invention. As stated above, the computer-based systems of the present invention comprise a data storage means having stored therein a nucleotide sequence of the present invention and the necessary hardware means and software means for supporting and implementing a search means. As used herein, "data storage means" refers to memory which can store nucleotide sequence information of the present invention, or a memory access means which can access manufactures having recorded thereon the nucleotide sequence information of the present invention.

As used herein, "search means" refers to one or more programs which are implemented on the computer-based system to compare a target sequence or target structural motif with the sequence information stored within the data storage means. Search means are used to identify fragments or regions of a known sequence which match a particular target sequence or target motif. A variety of known algorithms are disclosed publicly and a variety of commercially available software for conducting search means are and can be used in the computer-based systems of the present invention. Examples of such software includes, but is not limited to, Smith-Waterman, MacPattern (EMBL), BLASTN and BLASTA (NPOLYPEPTIDEIA). A skilled artisan can readily recognize that any one of the available algorithms or implementing software packages for conducting homology searches can be adapted for use in the present computer-based systems. As used herein, a "target sequence" can be any nucleic acid or amino acid sequence of six or more nucleotides or two or more amino acids. A skilled artisan can readily recognize that the longer a target sequence is, the less likely a target sequence will be present as a random occurrence in the database. The most preferred sequence length of a target sequence is from about 10 to 300 amino acids, more preferably from about 30 to 100 nucleotide residues. However, it is well recognized that searches for commercially important fragments, such as sequence fragments involved in gene expression and protein processing, may be of shorter length.

As used herein, "a target structural motif," or "target motif," refers to any rationally selected sequence or combination of sequences in which the sequence(s) are chosen based on a three-dimensional configuration which is formed upon the folding of the target motif. There are a variety of target motifs known in the art. Protein target motifs include, but are not limited to, enzyme active sites and signal sequences. Nucleic acid target motifs include, but are not limited to, promoter sequences, hairpin structures and inducible expression elements (protein binding sequences).

4.15 Triple Helix Formation

In addition, the fragments of the present invention, as broadly described, can be used to control gene expression through triple helix formation or antisense DNA or RNA, both of which methods are based on the binding of a polynucleotide sequence to DNA or RNA. Polynucleotides suitable for use in these methods are preferably 20 to 40 bases in length and are designed to be complementary to a region of the gene involved in transcription (triple helix—see Lee et al., Nucl. Acids Res. 6:3073 (1979); Cooney et al., Science 15241:456 (1988); and Dervan et al., Science 251:1360 (1991)) or to the mRNA itself (antisense—Olmno, J. Neurochem. 56:560 (1991); Oligodeoxynucleotides as Antisense Inhibitors of Gene Expression, CRC Press, Boca Raton, Fla. (1988)). Triple helix-formation optimally results in a shut-off of RNA transcription from DNA, while antisense RNA hybridization blocks translation of an mRNA molecule into polypeptide. Both techniques have been demonstrated to be effective in model systems. Information contained in the sequences of the present invention is necessary for the design of an antisense or triple helix oligonucleotide.

4.16 Diagnostic Assays and Kits

The present invention further provides methods to identify the presence or expression of one of the ORFs of the present invention, or homolog thereof, in a test sample, using a nucleic acid probe or antibodies of the present invention, optionally conjugated or otherwise associated with a suitable label.

In general, methods for detecting a polynucleotide of the invention can comprise contacting a sample with a compound that binds to and forms a complex with the polynucleotide for a period sufficient to form the complex, and detecting the complex, so that if a complex is detected, a polynucleotide of the invention is detected in the sample. Such methods can also comprise contacting a sample under stringent hybridization conditions with nucleic acid primers that anneal to a polynucleotide of the invention under such conditions, and amplifying annealed polynucleotides, so that if a polynucleotide is amplified, a polynucleotide of the invention is detected in the sample.

In general, methods for detecting a polypeptide of the invention can comprise contacting a sample with a compound that binds to and forms a complex with the polypeptide for a period sufficient to form the complex, and detecting the complex, so that if a complex is detected, a polypeptide of the invention is detected in the sample.

In detail, such methods comprise incubating a test sample with one or more of the antibodies or one or more of the nucleic acid probes of the present invention and assaying for binding of the nucleic acid probes or antibodies to components within the test sample.

Conditions for incubating a nucleic acid probe or antibody with a test sample vary. Incubation conditions depend on the format employed in the assay, the detection methods employed, and the type and nature of the nucleic acid probe or antibody used in the assay. One skilled in the art will recognize that any one of the commonly available hybridization, amplification or immunological assay formats can readily be adapted to employ the nucleic acid probes or antibodies of the present invention. Examples of such assays can be found in Chard, T., An Introduction to Radioimmunoassay and Related Techniques, Elsevier Science Publishers, Amsterdam, The Netherlands (1986); Bullock, G. R. et al., Techniques in Immunocytochemistry, Academic Press, Orlando, Fla. Vol. 1 (1982), Vol. 2 (1983), Vol. 3 (1985); Tijssen, P., Practice and Theory of immunoassays: Laboratory Techniques in Biochemistry and Molecular Biology, Elsevier Science Publishers, Amsterdam, The Netherlands (1985). The test samples of the present invention include cells, protein or membrane extracts of cells, or biological fluids such as sputum, blood, serum, plasma, or urine. The test sample used in the above-described method will vary based on the assay format, nature of the detection method and the tissues, cells or extracts used as the sample to be assayed. Methods for preparing protein extracts or membrane extracts of cells are well known in the art and can be readily be adapted in order to obtain a sample which is compatible with the system utilized.

In another embodiment of the present invention, kits are provided which contain the necessary reagents to carry out the assays of the present invention. Specifically, the invention provides a compartment kit to receive, in close confinement, one or more containers which comprises: (a) a first container comprising one of the probes or antibodies of the present invention; and (b) one or more other containers comprising one or more of the following: wash reagents, reagents capable of detecting presence of a bound probe or antibody.

In detail, a compartment kit includes any kit in which reagents are contained in separate containers. Such containers include small glass containers, plastic containers or strips of plastic or paper. Such containers allows one to efficiently transfer reagents from one compartment to another compartment such that the samples and reagents are not cross-contaminated, and the agents or solutions of each container can be added in a quantitative fashion from one compartment to another. Such containers will include a container which will accept the test sample, a container which contains the antibodies used in the assay, containers which contain wash reagents (such as phosphate buffered saline, Tris-buffers, etc.), and containers which contain the reagents used to detect the bound antibody or probe. Types of detection reagents include labeled nucleic acid probes, labeled secondary antibodies, or in the alternative, if the primary antibody is labeled, the enzymatic, or antibody binding reagents which are capable of reacting with the labeled antibody. One skilled in the art will readily recognize that the disclosed probes and antibodies of the present invention can be readily incorporated into one of the established kit formats which are well known in the art.

4.17 Medical Imaging

The novel polypeptides and binding partners of the invention are useful in medical imaging of sites expressing the molecules of the invention (e.g., where the polypeptide of the invention is involved in the immune response, for imaging sites of inflammation or infection). See, e.g., Kunkel et al., U.S. Pat. No. 5,413,778. Such methods involve chemical attachment of a labeling or imaging agent, administration of the labeled polypeptide to a subject in a pharmaceutically acceptable carrier, and imaging the labeled polypeptide in vivo at the target site.

4.18 Screening Assays

Using the isolated proteins and polynucleotides of the invention, the present invention further provides methods of obtaining and identifying agents which bind to a polypeptide encoded by an ORF corresponding to any of the nucleotide sequences set forth in SEQ ID NOs: 1–441, or bind to a specific domain of the polypeptide encoded by the nucleic acid. In detail, said method comprises the steps of:

(a) contacting an agent with an isolated protein encoded by an ORF of the present invention, or nucleic acid of the invention; and (b) determining whether the agent binds to said protein or said nucleic acid.

In general, therefore, such methods for identifying compounds that bind to a polynucleotide of the invention can comprise contacting a compound with a polynucleotide of the invention for a time sufficient to form a polynucleotide/compound complex, and detecting the complex, so that if a polynucleotide/compound complex is detected, a compound that binds to a polynucleotide of the invention is identified.

Likewise, in general, therefore, such methods for identifying compounds that bind to a polypeptide of the invention can comprise contacting a compound with a polypeptide of the invention for a time sufficient to form a polypeptide/compound complex, and detecting the complex, so that if a polypeptide/compound complex is detected, a compound that binds to a polynucleotide of the invention is identified.

Methods for identifying compounds that bind to a polypeptide of the invention can also comprise contacting a compound with a polypeptide of the invention in a cell for a time sufficient to form a polypeptide/compound complex, wherein the complex drives expression of a receptor gene sequence in the cell, and detecting the complex by detecting reporter gene sequence expression, so that if a polypeptide/compound complex is detected, a compound that binds a polypeptide of the invention is identified.

Compounds identified via such methods can include compounds which modulate the activity of a polypeptide of the invention (that is, increase or decrease its activity, relative to activity observed in the absence of the compound). Alternatively, compounds identified via such methods can include compounds which modulate the expression of a polynucleotide of the invention (that is, increase or decrease expression relative to expression levels observed in the absence of the compound). Compounds, such as compounds identified via the methods of the invention, can be tested using standard assays well known to those of skill in the art for their ability to modulate activity/expression.

The agents screened in the above assay can be, but are not limited to, peptides, carbohydrates, vitamin derivatives, or other pharmaceutical agents. The agents can be selected and screened at random or rationally selected or designed using protein modeling techniques.

For random screening, agents such as peptides, carbohydrates, pharmaceutical agents and the like are selected at random and are assayed for their ability to bind to the protein encoded by the ORF of the present invention. Alternatively, agents may be rationally selected or designed. As used herein, an agent is said to be "rationally selected or designed" when the agent is chosen based on the configuration of the particular protein. For example, one skilled in the art can readily adapt currently available procedures to generate peptides, pharmaceutical agents and the like, capable of binding to a specific peptide sequence, in order to generate rationally designed antipeptide peptides, for example see Hurby et al., Application of Synthetic Peptides: Antisense Peptides," In Synthetic Peptides, A User's Guide, W. H. Freeman, NY (1992), pp. 289–307, and Kaspczak et al., Biochemistry 28:9230–8 (1989), or pharmaceutical agents, or the like.

In addition to the foregoing, one class of agents of the present invention, as broadly described, can be used to control gene expression through binding to one of the ORFs or EMFs of the present invention. As described above, such agents can be randomly screened or rationally designed/selected. Targeting the ORF or EMF allows a skilled artisan to design sequence specific or element specific agents, modulating the expression of either a single ORF or multiple ORFs which rely on the same EMF for expression control. One class of DNA binding agents are agents which contain base residues which hybridize or form a triple helix formation by binding to DNA or RNA. Such agents can be based on the classic phosphodiester, ribonucleic acid backbone, or can be a variety of sulfhydryl or polymeric derivatives which have base attachment capacity.

Agents suitable for use in these methods preferably contain 20 to 40 bases and are designed to be complementary to a region of the gene involved in transcription (triple helix—see Lee et al., Nucl. Acids Res. 6:3073 (1979); Cooney et al., Science 241:456 (1988); and Dervan et al., Science 251:1360 (1991)) or to the mRNA itself (antisense—Okano, J. Neurochem. 56:560 (1991); Oligodeoxynucleotides as Antisense Inhibitors of Gene Expression, CRC Press, Boca Raton, Fla. (1988)). Triple helix-formation optimally results in a shut-off of RNA transcription from DNA, while antisense RNA hybridization blocks translation of an mRNA molecule into polypeptide. Both techniques have been demonstrated to be effective in model systems. Information contained in the sequences of the present invention is necessary for the design of an antisense or triple helix oligonucleotide and other DNA binding agents.

Agents which bind to a protein encoded by one of the ORFs of the present invention can be used as a diagnostic agent. Agents which bind to a protein encoded by one of the ORFs of the present invention can be formulated using known techniques to generate a pharmaceutical composition.

4.19 Use of Nucleic Acids as Probes

Another aspect of the subject invention is to provide for polypeptide-specific nucleic acid hybridization probes capable of hybridizing with naturally occurring nucleotide sequences. The hybridization probes of the subject invention may be derived from any of the nucleotide sequences SEQ ID NOs: 1–441. Because the corresponding gene is only expressed in a limited number of tissues, a hybridization probe derived from of any of the nucleotide sequences SEQ ID NOs: 1–441 can be used as an indicator of the presence of RNA of cell type of such a tissue in a sample.

Any suitable hybridization technique can be employed, such as, for example, in situ hybridization. PCR as described in U.S. Pat. Nos. 4,683,195 and 4,965,188 provides additional uses for oligonucleotides based upon the nucleotide sequences. Such probes used in PCR may be of recombinant origin, may be chemically synthesized, or a mixture of both. The probe will comprise a discrete nucleotide sequence for the detection of identical sequences or a degenerate pool of possible sequences for identification of closely related genomic sequences.

Other means for producing specific hybridization probes for nucleic acids include the cloning of nucleic acid sequences into vectors for the production of mRNA probes. Such vectors are known in the art and are commercially available and may be used to synthesize RNA probes in vitro by means of the addition of the appropriate RNA polymerase as T7 or SP6 RNA polymerase and the appropriate radioactively labeled nucleotides. The nucleotide sequences may be used to construct hybridization probes for mapping their respective genomic sequences. The nucleotide sequence provided herein may be mapped to a chromosome or specific regions of a chromosome using well known genetic and/or chromosomal mapping techniques. These techniques include in situ hybridization, linkage analysis against known chromosomal markers, hybridization screening with libraries or flow-sorted chromosomal preparations specific to known chromosomes, and the like. The technique of fluorescent in situ hybridization of chromosome spreads has been described, among other places, in Verma et al (1988) Human Chromosomes: A Manual of Basic Techniques, Pergamon Press, New York N.Y.

Fluorescent in situ hybridization of chromosomal preparations and other physical chromosome mapping techniques may be correlated with additional genetic map data. Examples of genetic map data can be found in the 1994 Genome Issue of Science (265:1981f). Correlation between the location of a nucleic acid on a physical chromosomal map and a specific disease (or predisposition to a specific disease) may help delimit the region of DNA associated with that genetic disease. The nucleotide sequences of the subject invention may be used to detect differences in gene sequences between normal, carrier or affected individuals.

4.20 Preparation of Support Bound Oligonucleotides

Oligonucleotides, i.e., small nucleic acid segments, may be readily prepared by, for example, directly synthesizing the oligonucleotide by chemical means, as is commonly practiced using an automated oligonucleotide synthesizer.

Support bound oligonucleotides may be prepared by any of the methods known to those of skill in the art using any suitable support such as glass, polystyrene or Teflon. One strategy is to precisely spot oligonucleotides synthesized by standard synthesizers. Immobilization can be achieved using passive adsorption (Inouye & Hondo, (1990) J. Clin. Microbiol. 28(6) 1469–72); using UV light (Nagata et al., 1985; Dahlen et al., 1987; Morrissey & Collins, (1989) Mol. Cell Probes 3(2) 189–207) or by covalent binding of base modified DNA (Keller et al., 1988; 1989); all references being specifically incorporated herein.

Another strategy that may be employed is the use of the strong biotin-streptavidin interaction as a linker. For example, Broude et al. (1994) Proc. Natl. Acad. Sci. USA 91(8) 3072–6, describe the use of biotinylated probes, although these are duplex probes, that are immobilized on streptavidin-coated magnetic beads. Streptavidin-coated beads may be purchased from Dynal, Oslo. Of course, this same linking chemistry is applicable to coating any surface with streptavidin. Biotinylated probes may be purchased from various sources, such as, e.g., Operon Technologies (Alameda, Calif.).

Nunc Laboratories (Naperville, Ill.) is also selling suitable material that could be used. Nunc Laboratories have developed a method by which DNA can be covalently bound to the microwell surface termed Covalink NH. CovaLink NH is a polystyrene surface grafted with secondary amino groups (>NH) that serve as bridge-heads for further covalent coupling. CovaLink Modules may be purchased from Nunc Laboratories. DNA molecules may be bound to CovaLink exclusively at the 5'-end by a phosphoramidate bond, allowing immobilization of more than 1 pmol of DNA rasmussen et al., (1991) Anal. Biochem. 198(1) 138–42).

The use of CovaLink NH strips for covalent binding of DNA molecules at the 5'-end has been described (Rasmussen et al., (1991). In this technology, a phosphoramidate bond is employed (Chu et al., (1983) Nucleic Acids Res. 11(8) 6513–29). This is beneficial as immobilization using only a single covalent bond is preferred. The phosphoramidate bond joins the DNA to the CovaLink NH secondary amino groups that are positioned at the end of spacer arms covalently grafted onto the polystyrene surface through a 2 nm long spacer arm. To link an oligonucleotide to CovaLink NH via an phosphoramidate bond, the oligonucleotide terminus must have a 5'-end phosphate group. It is, perhaps, even possible for biotin to be covalently bound to CovaLink and then streptavidin used to bind the probes.

More specifically, the linkage method includes dissolving DNA in water (7.5 ng/ul) and denaturing for 10 min. at 95° C. and cooling on ice for 10 min. Ice-cold 0.1 M 1-methylimidazole, pH 7.0 (1-MeIm$_7$), is then added to a final concentration of 10 mM 1-MeIm$_7$. A ss DNA solution is then dispensed into CovaLink NH strips (75 ul/well) standing on ice.

Carbodiimide 0.2 M 1-ethyl-3-(3-dimethylaminopropyl)-carbodiimide (EDC), dissolved in 10 mM 1-MeIm$_7$, is made fresh and 25 ul added per well. The strips are incubated for 5 hours at 50° C. After incubation the strips are washed using, e.g., Nunc-Immuno Wash; first the wells are washed 3 times, then they are soaked with washing solution for 5 min., and finally they are washed 3 times (where in the washing solution is 0.4 N NaOH, 0.25% SDS heated to 50° C.).

It is contemplated that a further suitable method for use with the present invention is that described in PCT Patent Application WO 90/03382 (Southern & Maskos), incorporated herein by reference. This method of preparing an oligonucleotide bound to a support involves attaching a nucleoside 3'-reagent through the phosphate group by a covalent phosphodiester link to aliphatic hydroxyl groups carried by the support. The oligonucleotide is then synthesized on the supported nucleoside and protecting groups removed from the synthetic oligonucleotide chain under standard conditions that do not cleave the oligonucleotide from the support. Suitable reagents include nucleoside phosphoramidite and nucleoside hydrogen phosphorate.

An on-chip strategy for the preparation of DNA probe for the preparation of DNA probe arrays may be employed. For example, addressable laser-activated photodeprotection may be employed in the chemical synthesis of oligonucleotides directly on a glass surface, as described by Fodor et al. (1991) Science 251(4995) 767–73, incorporated herein by reference. Probes may also be immobilized on nylon supports as described by Van Ness et al. (1991) Nucleic Acids Res. 19(12) 3345–50; or linked to Teflon using the method of Duncan & Cavalier (1988) Anal. Biochem. 169(1) 104–8; all references being specifically incorporated herein.

To link an oligonucleotide to a nylon support, as described by Van Ness et al. (1991), requires activation of the nylon surface via alkylation and selective activation of the 5'-amine of oligonucleotides with cyanuric chloride.

One particular way to prepare support bound oligonucleotides is to utilize the light-generated synthesis described by Pease et al., (1994) PNAS USA 91(11) 5022–6, incorporated herein by reference). These authors used current photolithographic techniques to generate arrays of immobilized oligonucleotide probes (DNA chips). These methods, in which light is used to direct the synthesis of oligonucleotide probes in high-density, miniaturized arrays, utilize photolabile 5'-protected N-acyl-deoxynucleoside phosphoramidites, surface linker chemistry and versatile combinatorial synthesis strategies. A matrix of 256 spatially defined oligonucleotide probes may be generated in this manner.

4.21 Preparation of Nucleic Acid Fragments

The nucleic acids may be obtained from any appropriate source, such as cDNAs, genomic DNA, chromosomal DNA, microdissected chromosome bands, cosmid or YAC inserts, and RNA, including mRNA without any amplification steps. For example, Sambrook et al. (1989) describes three protocols for the isolation of high molecular weight DNA from mammalian cells (p. 9.14–9.23).

DNA fragments may be prepared as clones in M13, plasmid or lambda vectors and/or prepared directly from genomic DNA or cDNA by PCR or other amplification methods. Samples may be prepared or dispensed in multiwell plates. About 100–1000 ng of DNA samples may be prepared in 2–500 ml of final volume.

The nucleic acids would then be fragmented by any of the methods known to those of skill in the art including, for example, using restriction enzymes as described at 9.24–9.28 of Sambrook et al. (1989), shearing by ultrasound and NaOH treatment.

Low pressure shearing is also appropriate, as described by Schriefer et al. (1990) Nucleic Acids Res. 18(24) 7455–6, incorporated herein by reference). In this method, DNA samples are passed through a small French pressure cell at a variety of low to intermediate pressures. A lever device allows controlled application of low to intermediate pressures to the cell. The results of these studies indicate that low-pressure shearing is a useful alternative to sonic and enzymatic DNA fragmentation methods.

One particularly suitable way for fragmenting DNA is contemplated to be that using the two base recognition endonuclease, CviJI, described by Fitzgerald et al. (1992)

Nucleic Acids Res. 20(14) 3753–62. These authors described an approach for the rapid fragmentation and fractionation of DNA into particular sizes that they contemplated to be suitable for shotgun cloning and sequencing.

The restriction endonuclease CviJI normally cleaves the recognition sequence PuGCPy between the G and C to leave blunt ends. Atypical reaction conditions, which alter the specificity of this enzyme (CviJI), yield a quasi-random distribution of DNA fragments form the small molecule pUC19 (2688 base pairs). Fitzgerald et al. (1992) quantitatively evaluated the randomness of this fragmentation strategy, using a CviJI digest of pUC19 that was size fractionated by a rapid gel filtration method and directly ligated, without end repair, to a lac Z minus M13 cloning vector. Sequence analysis of 76 clones showed that CviJI** restricts pyGCPy and PuGCPu, in addition to PuGCPy sites, and that new sequence data is accumulated at a rate consistent with random fragmentation.

As reported in the literature, advantages of this approach compared to sonication and agarose gel fractionation include: smaller amounts of DNA are required (0.2–0.5 ug instead of 2–5 ug); and fewer steps are involved (no preligation, end repair, chemical extraction, or agarose gel electrophoresis and elution are needed Irrespective of the manner in which the nucleic acid fragments are obtained or prepared, it is important to denature the DNA to give single stranded pieces available for hybridization. This is achieved by incubating the DNA solution for 2–5 minutes at 80–90° C. The solution is then cooled quickly to 2° C. to prevent renaturation of the DNA fragments before they are contacted with the chip. Phosphate groups must also be removed from genomic DNA by methods known in the art.

4.22 Preparation of DNA Arrays

Arrays may be prepared by spotting DNA samples on a support such as a nylon membrane. Spotting may be performed by using arrays of metal pins (the positions of which correspond to an array of wells in a microtiter plate) to repeated by transfer of about 20 nl of a DNA solution to a nylon membrane. By offset printing, a density of dots higher than the density of the wells is achieved. One to 25 dots may be accommodated in 1 $mm^2$, depending on the type of label used. By avoiding spotting in some preselected number of rows and columns, separate subsets (subarrays) may be formed. Samples in one subarray may be the same genomic segment of DNA (or the same gene) from different individuals, or may be different, overlapped genomic clones. Each of the subarrays may represent replica spotting of the same samples. In one example, a selected gene segment may be amplified from 64 patients. For each patient, the amplified gene segment may be in one 96-well plate (all 96 wells containing the same sample). A plate for each of the 64 patients is prepared. By using a 96-pin device, all samples maybe spotted on one 8x12 cm membrane. Subarrays may contain 64 samples, one from each patient. Where the 96 subarrays are identical, the dot span may be 1 $mm^2$ and there may be a 1 mm space between subarrays.

Another approach is to use membranes or plates (available from NUNC, Naperville, Ill.) which may be partitioned by physical spacers e.g. a plastic grid molded over the membrane, the grid being similar to the sort of membrane applied to the bottom of multiwell plates, or hydrophobic strips. A fixed physical spacer is not preferred for imaging by exposure to flat phosphor-storage screens or x-ray films.

The present invention is illustrated in the following examples. Upon consideration of the present disclosure, one of skill in the art will appreciate that many other embodiments and variations may be made in the scope of the present invention. Accordingly, it is intended that the broader aspects of the present invention not be limited to the disclosure of the following examples. The present invention is not to be limited in scope by the exemplified embodiments which are intended as illustrations of single aspects of the invention, and compositions and methods which are functionally equivalent are within the scope of the invention. Indeed, numerous modifications and variations in the practice of the invention are expected to occur to those skilled in the art upon consideration of the present preferred embodiments. Consequently, the only limitations which should be placed upon the scope of the invention are those which appear in the appended claims.

All references cited within the body of the instant specification are hereby incorporated by reference in their entirety.

5.0 EXAMPLES 5.1 Example 1

Novel Nucleic Acid Sequences Obtained from Various Libraries

A plurality of novel nucleic acids were obtained from cDNA libraries prepared from various human tissues and in some cases isolated from a genomic library derived from human chromosome using standard PCR, SBH sequence signature analysis and Sanger sequencing techniques. The inserts of the library were amplified with PCR using primers specific for the vector sequences which flank the inserts. Clones from cDNA libraries were spotted on nylon membrane filters and screened with oligonucleotide probes (e.g., 7-mers) to obtain signature sequences. The clones were clustered into groups of similar or identical sequences. Representative clones were selected for sequencing.

In some cases, the 5' sequence of the amplified inserts was then deduced using a typical Sanger sequencing protocol. PCR products were purified and subjected to fluorescent dye terminator cycle sequencing. Single pass gel sequencing was done using a 377 Applied Biosystems (ABI) sequencer to obtain the novel nucleic acid sequences. In some cases RACE (Random Amplification of cDNA Ends) was performed to further extend the sequence in the 5' direction.

5.2 Example 2

Novel Nucleic Acids

The novel nucleic acids of the present invention of the invention were assembled from sequences that were obtained from a cDNA library by methods described in Example 1 above, and in some cases sequences obtained from one or more public databases. The nucleic acids were assembled using an EST sequence as a seed. Then a recursive algorithm was used to extend the seed EST into an extended assemblage, by pulling additional sequences from different databases (i.e., Hyseq's database containing EST sequences, dbEST version 119, gb pri 119, and UniGene version 119) that belong to this assemblage. The algorithm terminated when there was no additional sequences from the above databases that would extend the assemblage. Inclusion of component sequences into the assemblage was based on a BLASTN hit to the extending assemblage with BLAST score greater than 300 and percent identity greater than 95%.

Using PHRAP (Univ. of Washington) or CAP4 (Paracel), a full length gene cDNA sequence and its corresponding protein sequence were generated from the assemblage. Any frame shifts and incorrect stop codons were corrected by hand editing. During editing, the sequence was checked using FASTY and/or BLAST against Genbank (i.e., dbEST version 120, gb pri 120, UniGene version 120, Genpept release 120). Other computer programs which may have been used in the editing process were phredphrap and Consed (University of Washington) and ed-ready, ed-ext and cg-zip-2 (Hyseq, Inc.). The full-length nucleotide and amino acid sequences, including splice variants resulting from these procedures are shown in the Sequence Listing as SEQ ID NOS: 1–441.

Table 1 shows the various tissue sources of SEQ ID NO: 1–441.

The homology for SEQ ID NO: 1–441 were obtained by a BLASTP version 2.0a1 19MP-WashU search against Genpept release 120 and the amino acid version of Geneseq released on Oct. 26, 2000, using BLAST algorithm. The results showed homologues for SEQ ID NO: 1–441 from Genpept. The homologues with identifiable functions for SEQ ID NO: 1–441 are shown in Table 2 below.

Using eMatrix software package (Stanford University, Stanford, Calif.) (Wu et al., J. Comp. Biol., Vol. 6 pp. 219–235 (1999) herein incorporated by reference), all the sequences were examined to determine whether they had identifiable signature regions. Table 3 shows the signature region found in the indicated polypeptide sequences, the description of the signature, the eMatrix p-value(s) and the position(s) of the signature within the polypeptide sequence.

Using the pFam software program (Sonnhammer et al., Nucleic Acids Res., Vol. 26(1) pp. 320–322 (1998) herein incorporated by reference) all the polypeptide sequences were examined for domains with homology to certain peptide domains. Table 4 shows the name of the domain found, the description, the p-value and the pFam score for the identified domain within the sequence.

The nucleotide sequence within the sequences that codes for signal peptide sequences and their cleavage sites can be determined from using Neural Network SignalP V1.1 program (from Center for Biological Sequence Analysis, The Technical University of Denmark). The process for identifying prokaryotic and eukaryotic signal peptides and their cleavage sites are also disclosed by Henrik Nielson, Jacob Engelbrecht, Soren Brunak, and Gunnar von Heijne in the publication "Identification of prokaryotic and eukaryotic signal peptides and prediction of their cleavage sites" Protein Engineering, Vol. 10, no. 1, pp. 1–6 (1997), incorporated herein by reference. A maximum S score and a mean S score, as described in the Nielson et as reference, was obtained for the polypeptide sequences. Table 5 shows the position of the signal peptide in each of the polypeptides and the maximum score and mean score associated with that signal peptide.

TABLE 1

| TISSUE ORIGIN | LIBRARY/ RNA SOURCE | HYSEQ LIBRARY NAME | SEQ ID NOS: |
|---|---|---|---|
| adult brain | GIBCO | AB3001 | 76–77 91 106–107 115 134 163–164 178 203 232 255 265 276 279 322–323 |
| adult brain | GIBCO | ABD003 | 16 19 24 77 80–81 85 89–90 92 96 98 105 110 116 121–123 125 130–132 134–136 138 142–143 151 153 158–159 163–164 184 191 193 196 198 200 208–209 213–214 216 219–220 223 229 232–234 236 239 241 243 257–259 262 265 267 274–276 278 284 292 302 317 321 324–325 327 337–338 340 348 359 371 391–392 400 |
| adult brain | Clontech | ABR001 | 1 18–19 35 80 98 125 136 153 185 200 209 221 228–229 239 243 274–275 302 399–400 |
| adult brain | Clontech | ABR006 | 5 7–8 18 32 35 52 57 85 91 96 111 113 126 131 135 138–139 142 148 153–154 181 188 192 199 209–211 217 221 224 226 229 233 235 238 243 248 273 283–284 286 292 316 322 348 357 361 367 376 378 399 407 409 417 428 |
| adult brain | Clontech | ABR008 | 2 4 6–11 19–21 23–25 31 35–37 39–41 45–46 72–73 76 80–81 85 88–90 94–95 97 102–105 109 111–112 114–119 121–122 126–131 134–135 138–139 144 146–150 152–153 156–157 159 168–172 174–175 178 180 182 185–186 189–190 194 196 198–201 203 205–210 217 219 221–222 224 229–230 232–233 236–239 243–244 248 253–256 260–261 263–265 273 276 281–282 286–289 291–292 299–300 302 304 315–317 319 321–322 324 326 329 331–332 341 352–357 360 362 365 367–368 370 376–377 379–380 383–384 387–389 391–392 394 396–402 407–410 412–413 419 425–426 433 |
| adult brain | Clontech | ABR011 | 85 90 |
| adult brain | BioChain | ABR012 | 148 213 |
| adult brain | Invitrogen | ABR013 | 85 322 |
| adult brain | Invitrogen | ABR014 | 9 23 85 146 200 233 282 321 330 |
| adult brain | Invitrogen | ABR015 | 14 31 69 121 124 163 209 216 224 291 377 |
| adult brain | Invitrogen | ABR016 | 92 136 219 279 |
| adult brain | Invitrogen | ABT004 | 2 7–8 20–21 33 85 90–91 95 97 102–103 108 121 123 129–131 138–139 143 146 151 153 157–158 172 178 180 209–210 213 219 229–230 232 234 239 308 321 330 360 365 370–373 375 401 412 |

TABLE 1-continued

| TISSUE ORIGIN | LIBRARY/ RNA SOURCE | HYSEQ LIBRARY NAME | SEQ ID NOS: |
|---|---|---|---|
| cultured preadipocytes | Strategene | ADP001 | 3–4 23 36 79 81 106–107 116 129 133–134 147 151 154 158 179 181 192 196 222 230 256–257 287 292 297 313 329 359 |
| adrenal gland | Clontech | ADR002 | 2 25 27 33 57 76 85–86 88 96 98 105–108 114 121–122 125 129–130 134 147 164 178 180 182 198–199 201 205 207–208 240–241 244 246 253–254 257 261 276 280 292 320 329 336 352 403 |
| adult heart | GIBCO | AHR001 | 3 17–21 27 32 74 76 85 89–91 95–96 102–103 105–110 117 121 124–125 128 131 134–136 139 141 148 151–153 155–156 161 163 181–182 186 190 193 198 200–201 205 207 211–213 215 222 225 229–230 234 251–254 257–259 263 274–277 280 292–297 301 303–304 315–316 319 329–331 345 359 384 417 423–424 |
| adult kidney | GIBCO | AKD001 | 3–5 14 16 19–29 34–35 76 79 85 89–90 94–95 97 101–103 106–107 115 117–118 121–122 124–125 128–130 133–136 138 144 146 158–159 163 166 171 177–178 182 185–186 189 194 196–198 200–201 205 207 211–213 216–217 223 225 228–232 243 247–248 253–255 257 267 272 277–278 283 287 291 298–301 315 326 358–359 364 |
| adult kidney | Invitrogen | AKT002 | 3 6 14 20–21 25–26 76 79 85 89 94 101 111 114 118 121 124 126 130–131 138 146 163 170 177–178 189 196 198 201 204 213 231 253–254 256–259 271 273–275 277 298 315 320 329 342 |
| adult lung | GIBCO | ALG001 | 4 29 74 79 85 90 96 105 111 119 132 134 136 142 144 149 159 181 189 198 200 205–207 226 255 257 263 283 294 300 302–303 328 358–359 365 426 |
| lymph node | Clontech | ALN001 | 6 16 31 105 120 215 257 295 306 309 359 |
| young liver | GIBCO | ALV001 | 10–11 25–26 29 31 33 76 85 95 115 121–122 124 126 130 143 146 156 158 164 178 182 187 189 229 248 253–254 261 278 283 304 342 375 |
| adult liver | Invitrogen | ALV002 | 10–12 23 26 31 33–34 38 53 56 90–92 94–95 118 121 124 128–129 138 141 146 148 153 156 161 171 178 198 216 232 248 253–254 256–257 264 302 306 365 375 383 396 |
| adult liver | Clontech | ALV003 | 10–11 156 171 188 |
| adult ovary | Invitrogen | AOV001 | 3–8 10–11 14 16 19–22 24 27–31 34 36 57 73 75–76 81–82 85 89–91 94–98 104–109 111 115–116 121–128 130–131 134 136 138–139 141 143–144 146 149–150 152 155 157–160 163–166 170–173 175 177–178 180 182 184–187 189–190 193–194 196–197 200–201 212–213 215 217 222 225–226 228 230–233 235 241–243 245 248 253–259 261 266–267 270 272–273 276–278 283–285 287 289 292 297–299 305–306 315–317 319 323–325 329–331 341 343–344 352 358–359 363–366 382–383 386 389–390 412 |
| adult placenta | Clontech | APL001 | 73 92 117 135 182 194 232 246 261 272 282 359 |
| placenta | Invitrogen | APL002 | 16 28 92 121 135 144 157 178 210 394 |
| adult spleen | GIBCO | ASP001 | 3–4 16 32–33 35 90 96 99–100 123–125 128 131 134 136 139 151 178 181 189 194 200 210 218 229 251 253–255 257 276 283 307–309 315 329 354–355 357 392 400 |
| testis | GIBCO | ATS001 | 22 73 82 91 96–97 104–105 117 124 130 134 164 173 200 209 222 233 241 253–254 257 285 287–288 305 325 329 351–353 359 |
| adult bladder | Invitrogen | BLD001 | 4 108 130 150 212 226 236 240 242 257 276 287 305 395–396 415 |

TABLE 1-continued

| TISSUE ORIGIN | LIBRARY/ RNA SOURCE | HYSEQ LIBRARY NAME | SEQ ID NOS: |
|---|---|---|---|
| bone marrow | Clontech | BMD001 | 1 4–5 22 29–30 34 72 85 88 90 92 94 98 104–107 109 111 113 117 120 123–125 128–129 132 135 140 142 144 146 152 163 165–166 170–173 177 180 182 186 189–190 198–209 215 222 225 232 240–246 251–252 260–261 273–275 277–280 283–285 300 316 318 346–347 359 |
| bone marrow | Clontech | BMD002 | 1 4 7–8 10–11 16 19 25 31 49 61–62 72 74 76 80 85 88 90 93–95 97–101 109–110 112 114 116–117 121 126 129 132 135 141 144 146 149–150 154 157 160 162–163 165–166 170–172 175 178–180 182–183 186–190 192–194 198–200 203 208 210–213 215 223 225 234 242 245 247 251–254 256–257 265 270 273 276–278 280 285 287 289 291 293–294 299 302 307 309 315 322 324 337–338 353 356–357 359 367 369 388 407 414 419 426 434 |
| bone marrow | Clontech | BMD007 | 144 |
| adult colon | Invitrogen | CLN001 | 4 25 33 85 138 146 148 158–159 198 210 229 301 360 384 397 |
| Mixture of 16 tissues - mRNAs* | Various Vendors* | CTL021 | 23 359 |
| Mixture of 16 tissues - mRNAs* | Various Vendors* | CTL028 | 172 |
| adult cervix | BioChain | CVX001 | 3 5 10–11 18 20–21 24–25 29 36 41 47 57 63 72 74 76 86 90 94 104 108–109 111 125 127 130 134 138 144 147 162 174 178–179 182 186 189 193 197 211 222 225–226 228 232 241 243 257 261 267 270 273–275 278–281 288–289 298 301–302 305 315 319 324–325 329 331 337–338 359 391–392 395 420 |
| endothelial cells | Strategene | EDT001 | 3–6 18–19 24 27–29 35 72 76 79–80 85 89 96 98 104–107 111 117 119–121 124–134 134 136 138–139 141 144 146–147 149 152 158–159 166–167 170–173 178–179 182–183 186–187 191 193–194 196–197 200 210–211 222–224 226 231–232 236 241 243 246 248 253–256 258–259 276 279 282 287 292 300 302–303 315 329 337–338 358–362 382–383 385–388 |
| Genomic clones from the short arm of chromosome 8 | Genomic DNA from Genetic Research | EPM001 | 435 |
| esophagus | BioChain | ESO002 | 257 |
| fetal brain | Clontech | FBR001 | 34 |
| fetal brain | Clontech | FBR004 | 3 139 144 271 284 337–338 |
| fetal brain | Clontech | FBR006 | 4 6–11 14 18–21 24 28 31 37–38 40 63 76 85 87 89–90 94–95 97 105 108–109 112–113 115 117–120 127–130 133 138 140 144–146 148 170 172 175 180 182 186–188 190 192 194 199 201 203 209–210 215 219 222 229–230 232–233 240 243 245 253–255 270 273 276 281 288–289 292 295 304 315 317 319 324 330–331 356–357 359–360 364 367–368 379–380 383 389 397 399–401 408–409 411 413 419 421 423 |
| fetal brain | Invitrogen | FBT002 | 2 14 19 23 28 31 90 94 105 121 124 126 131 135 139 142 149 158 186 193 198 210 214–215 232 239 242 248 255 267 326 332 365 369 371 376–383 394 399 |
| fetal heart | Invitrogen | FHR001 | 4 7–8 10–11 14 17–21 28–29 31–32 60 64–65 73 85 87 92 95 102–103 105 108 111 113 117 119 121 125 128–129 134–135 141 152 154 156–157 160–161 172 176 178 194 196 198–200 203 208 212 215 218 222 226 229 233–234 253–257 261 265 272 276 281 292–293 295 303 305 319 325 327 337–338 341 345 349 354–355 367–368 389 395–396 398 412 417 436 |

TABLE 1-continued

| TISSUE ORIGIN | LIBRARY/ RNA SOURCE | HYSEQ LIBRARY NAME | SEQ ID NOS: |
|---|---|---|---|
| fetal kidney | Clontech | FKD001 | 1 14 22 94 110 115 132 134–135 146 178 189 199 235–236 242 247 257 267 292 295 359 |
| fetal kidney | Clontech | FKD002 | 22 31 38 40 46 94 122 127 131 156 160 194 198 229 253–254 270 292 303 319 354–355 389 396 |
| fetal kidney | Invitrogen | FKD007 | 303 |
| fetal lung | Clontech | FLG001 | 85 89 98–100 111 175 271 281 369 |
| fetal lung | Invitrogen | FLG003 | 84 88 106–107 122 135 140 146 160 181 246 272 284 292 328 330 396 404 416 426 |
| fetal liver-spleen | Columbia University | FLS001 | 1–3 6–12 14 19 23 28–31 33 57 59–60 72–76 78 80 83 85–138 140–141 143–144 146–155 157–161 163–197 200 204 208 210–211 223 225 230 232–233 235 241–243 245–266 268–273 277 281 285–287 292 297 303 314 329 343 346–347 357–359 369 397 399 407 415 |
| fetal liver-spleen | Columbia University | FLS002 | 1 3–4 6 10–12 23–24 29 31–33 35–37 53–54 74–76 79 81–82 86–89 91 94–95 99–104 106–109 111–112 115 117–120 122 125–126 128–129 132 134 136–138 141 146 149 153 157–159 162–166 170 172 175 178–180 183 185–191 194 196–197 205 207–212 222–225 228 232–233 239–241 248 251–252 255–256 258–259 261–262 264 266–267 270–271 273–275 277–278 283 285 287 298 305 315 317–318 322 330–332 337–338 341 343 349 357–360 365 388 390–391 399 402 418 424 |
| fetal liver-spleen | Columbia University | FLS003 | 12 29 91 98 111 119 156 163 165 178 186 193 210–211 276 286 315 322 346–347 357 365 424 |
| fetal liver | Invitrogen | FLV001 | 7–8 14 35 118 122–123 129 146 182 211 230 232 248 251–252 264 287 304 337–338 344 346–347 352 365 367–369 |
| fetal liver | Clontech | FLV002 | 102–103 147 149 300 |
| fetal liver | Clontech | FLV004 | 73 85 105 108 118 122 126 141 156–157 161 165 170 178 180 182 194 215 218 225 240 242 247 251–252 292 330 337–338 369 407 411 440 |
| fetal muscle | Invitrogen | FMS001 | 17 80 85 90 139 147 153 173 178 198 201 220 229 236 293 296 303 323 334 341 345 359 372 |
| fetal muscle | Invitrogen | FMS002 | 5 9 17–18 20–21 29 38 85 88 97 106–107 129 131 136 150–152 155 165 170 179 182 192–193 212–213 229 234 242 258–259 270 282 286 289 300 316 319 345 351 354–355 360 389 396 408 410 437 439 |
| fetal skin | Invitrogen | FSK001 | 2 4 7–8 29 33 42–43 49 51–52 58 74 82 85 90 94 110–111 116 118 121 133 136 138–139 145 151 154 156–157 161–162 172 181 184 186 193 198 200 205 207 209–211 222 227–230 232 235 240 246 253–257 266 270 276 292 295 299 316 318 323 330 332 337–340 343 357 369 389 394–395 412 422 427 |
| fetal skin | Invitrogen | FSK002 | 4 9 42 44 51 66 72 81 85 89–90 95 98 105 112–114 119 121 129 133 135 162 172 179–182 197 200 208 210 231 243–244 272 304 316 330 339 354–355 357 360 389 395 410 417 437 |
| fetal spleen | BioChain | FSP001 | 157 223 |
| umbilical cord | BioChain | FUC001 | 4–6 20–21 25 29 73–74 83 87 89–91 94 101 109 120 123 125 128 130–131 133 141 143–144 147 149 154 161 165 173 175 179 184 188 210–212 217 226 235 240 248 251–252 257 262 267 270 277 293 305 307 316 319 323 327 331 341 356 359 389 392 407 416 |
| fetal brain | GIBCO | HFB001 | 2–4 16 20–21 74 77 85 89–91 96–98 104–105 111 114 118 121–122 124–125 127–128 131 134 137–140 142 144 146–148 151 153 158–159 163–164 166 173 178 |

TABLE 1-continued

| TISSUE ORIGIN | LIBRARY/ RNA SOURCE | HYSEQ LIBRARY NAME | SEQ ID NOS: |
|---|---|---|---|
| | | | 180 182 191 194 196 200 203 209–214 216–232 234–236 238–239 243 253–255 263 270 272–273 276 281 292 310 316 319–321 332 348 357 359 365 399 |
| macrophage | Invitrogen | HMP001 | 2 247 |
| infant brain | Columbia University | IB2002 | 2–4 7–8 19–22 26–27 31–32 35 73–74 80 85 89 91 96–98 106–107 110 112 118–119 121–122 125 128–131 134–144 148 153 164 166 172–173 177 180 186–187 191–194 196 202–203 208–210 217 219 223–224 227 229 232–234 236–237 239 241–243 245 248 253–259 273–275 278–279 282 287 294 298 309 314 317 322 327 330 333–334 341 348–350 360 368 376 379–380 382 396 406 424 |
| infant brain | Columbia University | IB2003 | 3–4 20–21 26 28 31 35 73 85 95–96 110 113 119 122–123 130–131 135 138 140 142–143 146 153 155 170 172–173 186 191–193 196 209 219 223 226 229 233–234 236 239 245 248 253–254 256–257 273 279 291–292 304 314 337–338 343 359 367 371 376 397 413 |
| infant brain | Columbia University | IBM002 | 129 138 140 193 209 251–252 256 317 373 397 |
| infant brain | Columbia University | IBS001 | 31 48 85 138 151 180 193 229 239 265 292 326 337–338 371 |
| lung, fibroblast | Strategene | LFB001 | 3 6 31 72–73 90 92 105–107 124 126–127 133 136 139 144 146 172 189 198 204 233 235 246 258–259 268 272 276 282 310 335 359 434 |
| lung tumor | Invitrogen | LGT002 | 4 19–21 28 33 35–36 49 72 79 81 85 88 90–91 94–95 101 106–107 109 118 120–125 127 130–131 133 135–138 141–142 144 147 149 157 159–161 163 166 170–173 193–194 196–197 212 216 218 221 223 226 228–229 231 233 241 247–248 253–255 257 261 266–267 270–275 277–278 282–283 292 298 301 303 315 318 324 331 335 354–355 359 367 369 381 392–393 398 |
| lymphocytes | ATCC | LPC001 | 4 6 10–11 16 42 76 88 91 95–98 104 109 114 120 122 133–134 144 146 148 157–158 161 164 171 180 186–187 203 209 212 223 231 242–243 248 251–252 255 258–259 271–273 281–282 299 334 336 362 374 418 |
| leukocyte | GIBCO | LUC001 | 1–5 15 19–21 28 30–33 37 72 74 91 94–95 97–100 108–109 113 115 117 119–122 124–125 127–128 134–138 141 144 146–148 150–151 157–158 160 162–167 170–173 175–178 180–181 187 189 192 194 197 200 212–213 215–216 218–219 223 225 228–232 241–242 245–246 251–254 261 272–276 278–282 284 287–290 297–298 305 307 310–314 325 331 336 340 358–359 372 399 414 |
| leukocyte | Clontech | LUC003 | 1 5 124 171 176 204 225 248 253–254 283 285 307 315 |
| melanoma from cell line ATCC #CRL 1424 | Clontech | MEL004 | 4–5 24 37 72–74 81 85 106–107 113 136 177 203 205–207 209 231 243 284–285 315–316 320 326 359 374 428 |
| mammary gland | Invitrogen | MMG001 | 2 4–5 7–8 10–12 29 31 34–35 38 50 80–81 85 89–90 92 94–97 105 108–109 119–124 126 128–130 135 138–139 141–142 144 146–147 153 155 157–159 163 178–179 181–182 198 200 209–210 219 223 228 230 232–233 235–236 239 242 248 253–255 257 260–261 265–267 270 272 281 287 292 294 315–316 318 324 327 330 337–340 354–355 357 369 372 383 392–395 401 404 |
| induced neuron cells | Strategene | NTD001 | 35 47 89–90 111 118 164 232 253–254 276 324 331 382 |
| retinoid acid induced neuronal cells | Strategene | NTR001 | 20–21 37 122 147–149 170 179 181 186 212 226 258–259 265 276 369 436 438 |

TABLE 1-continued

| TISSUE ORIGIN | LIBRARY/ RNA SOURCE | HYSEQ LIBRARY NAME | SEQ ID NOS: |
|---|---|---|---|
| neuronal cells | Strategene | NTU001 | 7–8 37 55 80 85 112 118 126–127 133 138 140–141 151 170 181 210 214 225–226 236 243 287 328 330–331 357 383 400 436 |
| pituitary gland | Clontech | PIT004 | 92 124 159 231 |
| placenta | Clontech | PLA003 | 34 46 88 126 128 159 182 186 197 201 267 278 281–282 305 330 356 361 365 418 |
| prostate | Clontech | PRT001 | 18 36 72 74 86 95 106–107 111 118 122 144 161 179 211 218 233 286 297 |
| rectum | Invitrogen | REC001 | 9 31 85 121 128 147 171 200 219 257 292 340 394 398 407 412 |
| salivary gland | Clontech | SAL001 | 3 24 38 80 122 136 147 189 241 282 296 310 351 392 395 415 |
| salivary gland | Clontech | SALs03 | 118 |
| skin fibroblast | ATCC | SFB003 | 257 |
| small intestine | Clontech | SIN001 | 12 16 25 82–83 89–90 93 95 98 105–109 111 122–123 125–128 133–134 137 139 142 161 167 171 184 197 201 204 212 218 236 242–243 248–249 253–254 257 267 276 284–285 292 297 300 303 310 313 317–318 325 340 343 352 354–355 359 383 391 416 |
| skeletal muscle | Clontech | SKM001 | 3 85 90 121 136 154 200 211–212 224 234–235 272 288 293 303 353 426 |
| spinal cord | Clontech | SPC001 | 3 39 84 86 94 96 105 115 117 130–131 134 136 141 143 148 155 176 190–191 203 213 224 233–234 236 239 279 283 298 320–321 332 336–338 356 359 365 404–406 |
| adult spleen | Clontech | SPLc01 | 7–8 35 80 94 106–107 120 133 144 152 155 241 253–254 263 329 407 428 |
| stomach | Clontech | STO001 | 10–11 23 30 77 98 106–107 117 131 135 139 144 257 285 343 367 382 394 |
| thalamus | Clontech | THA002 | 2 20–21 23 74 81 85 105–106 116 121 131 146 171 185 188 200 209 219 233 239 256 258–259 273 276 362 399 |
| thymus | Clontech | THM001 | 16 29 33 57 80 82 85 90 93–94 106–107 120 126 128 134 141 161 176 194 223 228 235 253–254 261 274–275 278 285 298 319 332 336 343 353 359 425 |
| thymus | Clontech | THMc02 | 1–2 7–9 14 26 34 44 73 75 82 85 87 94 98 106–107 109–111 117 119–120 125–126 128–129 139 141 144 147–148 151 154–155 162 165 170–172 175–176 179 182 186 193–194 199–200 208–209 213 218 233 235 240 242 247 253–254 257 265 276 281 287 290 305 307 312 319 336 342 354–356 359 364 367 399 408 412–413 415 419 421 426 429–433 |
| thyroid gland | Clontech | THR001 | 3 5 7–8 28 30–31 33 73–77 80 82 85 88 90–92 94 96–98 105–107 109 113 117 121–122 124–125 127–128 130 134 136 141 143 146–148 152 161–163 166 175 177–178 181 194 199 201 204 210 212 216 218 223–226 228 230–231 234 236 241 243 246 253–257 261 270 272–273 276–278 281–283 287 292 295 298 303–304 308 315 323 329 335 352 359 362 401 416–417 |
| trachea | Clontech | TRC001 | 88 138 180 226 228 279 359 411 436 |
| uterus | Clontech | UTR001 | 3 10–11 23 77 92 106–107 109 111 141 197–198 218 241 257 270 274–275 302 315 329 396 400 413 |

*The 16 tissue-mRNAs and their vendor source, are as follows: 1) Normal adult brain mRNA (Invitrogen), 2) normal adult kidney mRNA (Invitrogen), 3) normal adult liver mRNA (Invitrogen), 4) normal fetal brain mRNA (Invitrogen), 5) normal fetal kidney mRNA (Invitrogen), 6) normal fetal liver mRNA (Invitrogen), 7) normal fetal skin mRNA (Invitrogen), 8) human adrenal gland mRNA (Clontech), 9) human bone marrow mRNA (Clontech), 10) humanleukemia lymphablastic mRNA (Clontech), 11) human thymus mRNA (Clontech), 12) human lymph node mRNA (Clontech), 13) human spinal cord mRNA (Clontech), 14) human thyroid mRNA (Clontech), 15) human esophagus mRNA (BioChain), 16) human conceptional umbilical cord mRNA (BioChain).

TABLE 2

| SEQ ID NO: | ACCESSION NUMBER | DESCRIPTION | SMITH-WATERMAN SCORE | % IDENTITY |
|---|---|---|---|---|
| 1 | AF255303 | *Homo sapiens* membrane-associated nucleic acid binding protein | 2074 | 67 |
| 2 | Y57911 | Human transmembrane protein HTMPN-35 | 865 | 94 |
| 3 | AL121961 | *Homo sapiens* dJ104A17.1 (novel protein) | 1426 | 100 |
| 4 | X90872 | *Homo sapiens* associated to Golgi apparatus | 1096 | 98 |
| 5 | AL161659 | *Homo sapiens* bA526K24.1 (A novel protein) | 4348 | 99 |
| 6 | AF047185 | *Homo sapiens* NADH-ubiquinone oxidoreductase subunit CI-B8 | 505 | 100 |
| 7 | AL162458 | *Homo sapiens* bA465L10.1 (novel protein similar to Drosophila CG11399) | 3765 | 100 |
| 8 | AL162458 | *Homo sapiens* bA465L10.1 (novel protein similar to Drosophila CG11399) | 3366 | 100 |
| 9 | U28928 | *Caenorhabditis elegans* similar to *C. elegans* protein F59B2.2 | 450 | 30 |
| 10 | U66411 | *Drosophila melanogaster* putative type III alcohol dehydrogenase | 336 | 57 |
| 11 | U66411 | *Drosophila melanogaster* putative type III alcohol dehydrogenase | 425 | 52 |
| 13 | AL096710 | *Homo sapiens* dJ61B2.2 (similar to MACF cytoskeletal protein) | 733 | 99 |
| 14 | L05093 | *Homo sapiens* ribosomal protein L18a | 887 | 93 |
| 16 | AF061961 | *Mus musculus* putative zinc finger protein FLIZ1 | 345 | 33 |
| 17 | U76373 | *Mus musculus* skm-BOP1 | 2494 | 94 |
| 18 | AJ272073 | *Torpedo marmorata* male sterility protein 2-like protein | 2307 | 80 |
| 19 | Z82084 | *Caenorhabditis elegans* contains similarity to Pfam domain: PF01769 (Divalent cation transporter), Score = 211.5, E-value = 4.2e−60, N = 2 | 279 | 27 |
| 20 | AF090989 | *Homo sapiens* high-risk human papilloma viruses E6 oncoproteins targeted protein E6TP1 alpha; putative GAP protein alpha | 3089 | 68 |
| 21 | AF090989 | *Homo sapiens* high-risk human papilloma viruses E6 oncoproteins targeted protein E6TP1 alpha; putative GAP protein alpha | 3089 | 68 |
| 22 | U20286 | *Rattus norvegicus* lamina associated polypeptide 1C | 739 | 59 |
| 23 | AF207829 | *Homo sapiens* SCAN-related protein RAZ1 | 1104 | 100 |
| 24 | X78817 | *Homo sapiens* p115 | 1118 | 45 |
| 25 | D86417 | *Bacillus subtilis* YfmJ | 359 | 43 |
| 26 | L01083 | *Oryctolagus cuniculus* UDP-glucuronosyltransferase | 683 | 36 |
| 27 | AF000240 | *Gallus gallus* monocarboxylate transporter 3 | 385 | 37 |
| 28 | Z36948 | *Caenorhabditis elegans* contains 3 cysteine rich repeats | 138 | 42 |

TABLE 2-continued

| SEQ ID NO: | ACCESSION NUMBER | DESCRIPTION | SMITH-WATERMAN SCORE | % IDENTITY |
|---|---|---|---|---|
| 29 | D17554 | *Homo sapiens* TAXREB107 | 1207 | 98 |
| 30 | L06505 | *Homo sapiens* ribosomal protein L12 | 845 | 100 |
| 31 | AL136538 | *Schizosaccharomyces pombe* putative cysteinyl-trna synthetase | 680 | 37 |
| 32 | AB040900 | *Homo sapiens* KIAA1467 protein | 2232 | 100 |
| 33 | AL031685 | *Homo sapiens* dJ963K23.2 (novel protein) | 521 | 46 |
| 34 | AF263742 | *Homo sapiens* golgin-like protein | 297 | 45 |
| 35 | AF030131 | *Mus musculus* Plenty of SH3s; POSH | 2951 | 88 |
| 36 | Z22818 | *Canis familiaris* Rab12 protein | 1071 | 99 |
| 37 | AL110477 | *Caenorhabditis elegans* Y113G7B.24 | 198 | 34 |
| 38 | AC002505 | *Arabidopsis thaliana* putative phosphatidylinositol-4-phosphate 5-kinase | 157 | 28 |
| 39 | AF099810 | *Homo sapiens* neurexin III-alpha | 1255 | 99 |
| 40 | AL133215 | *Homo sapiens* bA108L7.6 (semaphorin 4G (sema domain, immunoglobulin domain (Ig), transmembrane domain (TM) and short cytoplasmic domain) ) | 4406 | 99 |
| 41 | AL109657 | *Homo sapiens* dJ842G6.1 (novel protein) | 247 | 100 |
| 42 | AB033744 | *Mus musculus* type II cytokeratin | 2419 | 91 |
| 43 | M27685 | *Mus musculus* ultra-high sulphur keratin | 702 | 60 |
| 44 | M94081 | *Homo sapiens* putative | 110 | 100 |
| 46 | AJ278348 | *Homo sapiens* pregnancy-associated plasma protein-E | 8966 | 99 |
| 47 | Z98762 | *Schizosaccharomyces pombe* profilin. | 190 | 36 |
| 48 | AF026544 | *Ralstonia eutropha* phbF | 561 | 66 |
| 49 | AB036882 | *Mus musculus* midnolin | 950 | 67 |
| 50 | Z46967 | *Homo sapiens* calicin | 3076 | 99 |
| 51 | AF204929 | *Sus scrofa* thyroxine-binding globulin | 1060 | 52 |
| 52 | AL035694 | *Homo sapiens* dJ33L1.1 (novel T-box (Brachyury) family protein) | 2634 | 100 |
| 54 | AF079864 | *Rattus norvegicus* putative G-protein coupled receptor RA1c | 508 | 51 |
| 55 | AL022373 | *Arabidopsis thaliana* glycine-rich protein | 200 | 35 |
| 56 | AJ007767 | *Homo sapiens* T-cell antigen receptor-alpha | 566 | 97 |
| 57 | AF041107 | *Rattus norvegicus* tulip 2 | 1884 | 94 |
| 58 | L32179 | *Homo sapiens* arylacetamide deacetylase | 1035 | 52 |
| 59 | AB010414 | *Homo sapiens* G-protein gamma 7 | 127 | 56 |
| 60 | AJ277486 | *Mus musculus* T-box transcription factor | 1463 | 93 |
| 61 | AF164612 | *Homo sapiens* Gag protein | 131 | 29 |
| 62 | S61069 | *Homo sapiens* reverse transcriptase homolog = pol {retroviral element} | 232 | 80 |
| 63 | AF266172 | *Gillichthys mirabilis* 60S acidic ribosomal protein P1 | 127 | 81 |

TABLE 2-continued

| SEQ ID NO: | ACCESSION NUMBER | DESCRIPTION | SMITH-WATERMAN SCORE | % IDENTITY |
|---|---|---|---|---|
| 64 | M18184 | *Mus musculus* lymphocyte differentiation antigen | 140 | 37 |
| 65 | AL035587 | *Homo sapiens* dJ475N16.3 (novel protein similar to RPL7A (60S ribosomal protein L7A)) | 434 | 88 |
| 66 | M34225 | *Homo sapiens* cytokeratin 8 | 866 | 64 |
| 67 | Y17166 | *Campylobacter jejuni* ribosomal protein S6 | 111 | 31 |
| 68 | AF252290 | *Mus musculus* PAR6A | 1492 | 76 |
| 69 | Z46787 | *Caenorhabditis elegans* contains similarity to Pfam domain: PF00097 (Zinc finger, C3HC4 type (RING finger)), Score = 17.6, E-value = 0.00013, N = 1 | 522 | 51 |
| 70 | AF205718 | *Homo sapiens* hepatocellular carcinoma-related putative tumor suppressor | 473 | 76 |
| 71 | AJ006692 | *Homo sapiens* ultra high sulfer keratin | 774 | 79 |
| 72 | AK001269 | *Homo sapiens* unnamed protein product | 3518 | 100 |
| 73 | AE003453 | *Drosophila melanogaster* CG9752 gene product | 756 | 43 |
| 74 | AK000725 | *Homo sapiens* unnamed protein product | 3013 | 100 |
| 75 | AF231921 | *Homo sapiens* unknown | 1215 | 100 |
| 76 | AK024664 | *Homo sapiens* unnamed protein product | 2522 | 100 |
| 77 | AL133661 | *Homo sapiens* hypothetical protein | 1612 | 100 |
| 78 | AK000765 | *Homo sapiens* unnamed protein product | 1450 | 100 |
| 79 | AK023453 | *Homo sapiens* unnamed protein product | 774 | 100 |
| 80 | AK000474 | *Homo sapiens* unnamed protein product | 737 | 100 |
| 81 | W93948 | Human regulatory molecule HRM-4 protein | 441 | 91 |
| 82 | AK024435 | *Homo sapiens* FLJ00025 protein | 145 | 24 |
| 83 | AK000820 | *Homo sapiens* unnamed protein product | 652 | 100 |
| 84 | AL080154 | *Homo sapiens* hypothetical protein | 838 | 100 |
| 85 | D45131 | *Homo sapiens* basigin | 1302 | 99 |
| 86 | AL365412 | *Homo sapiens* hypothetical protein, similar to (NP_006139.1) LASP-1, LIM and SH3 domain protein 1 | 580 | 100 |
| 87 | L03188 | *Saccharomyces cerevisiae* putative | 216 | 26 |
| 88 | X74855 | *Mus musculus* zinc finger protein 51 | 362 | 31 |
| 89 | AF152344 | *Mus musculus* F2 alpha prostoglandin regulatory protein | 4195 | 89 |
| 90 | AF020262 | *Bos taurus* general protein transport factor p16 | 607 | 100 |
| 91 | AL096882 | *Arabidopsis thaliana* putative protein | 146 | 24 |
| 92 | M75099 | *Homo sapiens* rapamycin- and FK506-binding protein | 740 | 100 |
| 93 | AF163151 | *Homo sapiens* dentin sialophosphoprotein precursor | 162 | 22 |
| 94 | AL078593 | *Homo sapiens* dJ210B1.1 (KIAA0680) | 745 | 40 |

TABLE 2-continued

| SEQ ID NO: | ACCESSION NUMBER | DESCRIPTION | SMITH-WATERMAN SCORE | % IDENTITY |
|---|---|---|---|---|
| 95 | AJ223802 | *Arabidopsis thaliana* 2-oxoglutarate dehydrogenase, E1 subunit | 1463 | 42 |
| 96 | AB020749 | *Arabidopsis thaliana* | 144 | 24 |
| 97 | U06944 | *Mus musculus* PRAJA1 | 1087 | 76 |
| 98 | AL096678 | *Homo sapiens* dJ122O8.4 (KIAA0301) | 10626 | 100 |
| 99 | AL356276 | *Homo sapiens* bA367J7.7 (novel Immunoglobulin domains containing protein) | 1533 | 100 |
| 100 | AL356276 | *Homo sapiens* bA367J7.7 (novel Immunoglobulin domains containing protein) | 1533 | 100 |
| 101 | AF200691 | *Drosophila melanogaster* Dispatched | 1031 | 38 |
| 102 | AF177144 | *Mus musculus* mammalian inositol hexakisphosphate kinase 1 | 1027 | 50 |
| 103 | AF177144 | *Mus musculus* mammalian inositol hexakisphosphate kinase 1 | 1039 | 51 |
| 104 | AL021918 | *Homo sapiens* b34I8.1 (Kruppel related Zinc Finger protein 184) | 1624 | 48 |
| 105 | X69115 | *Homo sapiens* ZNF37A | 1371 | 99 |
| 106 | AF142406 | *Babesia bigemina* 200 kDa antigen p200 | 325 | 24 |
| 107 | AF161358 | *Homo sapiens* HSPC095 | 419 | 100 |
| 108 | AL163852 | *Arabidopsis thaliana* putative protein | 142 | 30 |
| 109 | Z99531 | *Schizosaccharomyces pombe* caffeine-induced death protein 1 | 346 | 31 |
| 110 | M29580 | *Homo sapiens* zinc finger protein 7 (ZFP7) | 510 | 57 |
| 111 | L00923 | *Mus musculus* myosin I | 5389 | 96 |
| 112 | AP001751 | *Homo sapiens* gene similar to rat protein kinase (KID2) | 1527 | 50 |
| 113 | Y12781 | *Homo sapiens* transducin (beta) like 1 protein | 2431 | 86 |
| 114 | AF215703 | *Drosophila melanogaster* KISMET-L long isoform | 2090 | 66 |
| 115 | AL023828 | *Caenorhabditis elegans* cDNA EST yk167h7.3 comes from this gene~cDNA EST yk167h7.5 comes from this gene~cDNA EST yk289g5.3 comes from this gene~cDNA EST yk332h9.3 comes from this gene~cDNA EST yk289g5.5 comes from this gene~cDNA EST yk332h9.5 comes from this gene~cDNA EST yk391h4.5 comes from this gene~cDNA EST yk653f1.5 comes from this gene | 445 | 48 |
| 116 | AF125960 | *Caenorhabditis elegans* contains similarity to dual specificity phosphatase, catalyitic domain (Pfam: PF00782, Score = 16.8, E = 7.4e−05, N = 1) | 475 | 35 |
| 117 | AF151697 | *Homo sapiens* sentrin-specific protease | 3110 | 99 |
| 118 | AF022655 | *Homo sapiens* cep250 centrosome associated protein | 139 | 24 |

TABLE 2-continued

| SEQ ID NO: | ACCESSION NUMBER | DESCRIPTION | SMITH-WATERMAN SCORE | % IDENTITY |
|---|---|---|---|---|
| 119 | AK026098 | Homo sapiens unnamed protein product | 1950 | 99 |
| 120 | X56203 | Plasmodium falciparum liver stage antigen | 504 | 25 |
| 121 | U21324 | Caenorhabditis elegans similar to entire S. cerevisiae ABC1 protein (Swiss-Prot Acc: P27697) | 1197 | 52 |
| 122 | AL138641 | Arabidopsis thaliana putative protein | 579 | 33 |
| 123 | S73591 | Homo sapiens brain-expressed HHCPA78 homolog VDUP1 | 674 | 38 |
| 124 | D00761 | Homo sapiens proteasome subunit C5 | 857 | 94 |
| 125 | AF000262 | Caenorhabditis elegans similar to CCAAT/enhancer-binding protein | 343 | 36 |
| 126 | AF146075 | Thermus thermophilus ribosomal protein L9 | 144 | 31 |
| 127 | AC006585 | Arabidopsis thaliana putative SUDD-like protein | 1129 | 46 |
| 128 | AL031804 | Arabidopsis thaliana putative protein | 186 | 25 |
| 129 | AL035539 | Arabidopsis thaliana putative protein | 140 | 27 |
| 130 | AF151816 | Homo sapiens CGI-58 protein | 1023 | 54 |
| 131 | AC024765 | Caenorhabditis elegans contains similarity to O-linked GlcNAc transferases | 223 | 33 |
| 132 | M12623 | Homo sapiens high mobility group protein 17 | 320 | 95 |
| 133 | AB017614 | Mus musculus OASIS protein | 2409 | 91 |
| 134 | AL109827 | Homo sapiens dJ309K20.4 (KIAA0765 (HRIHFB2091, RNA recognition motif (RNP, RRM or RBD domain) containing protein) ) | 4972 | 100 |
| 135 | AL035661 | Homo sapiens dJ568C11.3 (novel AMP-binding enzyme similar to acetyl-coenzyme A synthethase (acetate-coAligase)) | 2526 | 100 |
| 136 | AL031804 | Arabidopsis thaliana putative protein | 237 | 35 |
| 137 | AL161590 | Arabidopsis thaliana putative protein | 232 | 34 |
| 138 | AB024032 | Arabidopsis thaliana gene_id: K9P8.4~ | 372 | 55 |
| 139 | AL050367 | Homo sapiens hypothetical protein | 4177 | 94 |
| 140 | AF081484 | Homo sapiens alpha-tubulin isoform 1 | 1195 | 97 |
| 141 | D14336 | Mus musculus RNA polymerase I associated factor (PAF53) | 1694 | 77 |
| 142 | AF023657 | Rattus norvegicus endo-alpha-D-mannosidase | 1415 | 67 |
| 143 | AB011541 | Homo sapiens MEGF8 | 9785 | 100 |
| 144 | AF112221 | Homo sapiens rap2 interacting protein x | 1189 | 60 |
| 145 | AF117382 | Mus musculus hypermethylated in cancer 2 protein; HIC2 | 1333 | 91 |
| 146 | AF151827 | Homo sapiens CGI-69 protein | 1794 | 97 |
| 147 | AC024792 | Caenorhabditis elegans | 424 | 35 |

TABLE 2-continued

| SEQ ID NO: | ACCESSION NUMBER | DESCRIPTION | SMITH-WATERMAN SCORE | % IDENTITY |
|---|---|---|---|---|
| | | contains similarity to TR: P78316 | | |
| 148 | AL022603 | *Arabidopsis thaliana* putative protein | 369 | 32 |
| 149 | AF016430 | *Caenorhabditis elegans* similar to Pan Troglodytes GOR (SP: P48778) | 370 | 43 |
| 150 | X15696 | *Homo sapiens* translated region (partial) | 129 | 28 |
| 151 | AL022373 | *Arabidopsis thaliana* putative protein | 137 | 33 |
| 152 | AB010077 | *Arabidopsis thaliana* GTP-binding membrane protein LepA homolog | 881 | 56 |
| 153 | AF062655 | *Mus musculus* plenty-of-prolines-101; POP101; SH3-philo-protein | 115 | 29 |
| 154 | AF159852 | *Drosophila melanogaster* RNA-binding protein Smaug | 243 | 48 |
| 155 | AE003606 | *Drosophila melanogaster* CG14646 gene product | 465 | 32 |
| 156 | AE004999 | *Halobacterium sp.* NRC-1 dihydrodipicolinate synthase; DapA | 335 | 35 |
| 157 | AL157953 | *Streptomyces coelicolor* A3 (2) putative nitroreductase | 143 | 28 |
| 158 | AF116238 | *Homo sapiens* pseudouridine synthase 1 | 1927 | 99 |
| 159 | AF263541 | *Homo sapiens* protein kinase DYRK4 | 2844 | 100 |
| 160 | Z81317 | *Schizosaccharomyces pombe* putative ubiquitin carboxyl-terminal hydrolase | 148 | 37 |
| 161 | Y18208 | *Rattus norvegicus* serine-threonine specific protein phosphatase, glycogen-binding (GL) subunit | 1360 | 89 |
| 162 | AC005970 | *Arabidopsis thaliana* putative translation initiation factor eIF-2B alpha subunit | 926 | 58 |
| 163 | M83822 | *Homo sapiens* beige-like protein | 9733 | 99 |
| 164 | AL080282 | *Arabidopsis thaliana* putative protein | 352 | 34 |
| 165 | U61232 | *Homo sapiens* cofactor E | 292 | 27 |
| 166 | AB014578 | *Homo sapiens* KIAA0678 protein | 5255 | 100 |
| 167 | X61123 | *Homo sapiens* BTG1 | 813 | 96 |
| 168 | Z92954 | *Bacillus subtilis* product highly similar to metabolite transport proteins | 570 | 38 |
| 169 | AL031055 | *Homo sapiens* dJ28H20.1 (novel protein similar to membrane transport proteins) | 636 | 44 |
| 170 | AL021918 | *Homo sapiens* b34I8.1 (Kruppel related Zinc Finger protein 184) | 1144 | 46 |
| 171 | U44731 | *Mus musculus* purine nucleotide binding protein | 2260 | 70 |
| 172 | AF211859 | *Mus musculus* cyclin ania-6b | 1052 | 92 |
| 173 | AF181252 | *Mus musculus* TPR-containing protein involved in spermatogenesis TPIS | 266 | 31 |
| 174 | AF096864 | *Pseudomonas aeruginosa* heat shock protein | 173 | 33 |

TABLE 2-continued

| SEQ ID NO: | ACCESSION NUMBER | DESCRIPTION | SMITH-WATERMAN SCORE | % IDENTITY |
|---|---|---|---|---|
| 175 | AB042199 | Homo sapiens APC-stimulated guanine nucleotide exchange factor | 1783 | 62 |
| 176 | Z11582 | Saccharomyces cerevisiae nuf1 | 151 | 25 |
| 177 | AJ235270 | Rickettsia prowazekii PROBABLE O-SIALOGLYCOPROTEIN ENDOPEPTIDASE (gcp) | 376 | 37 |
| 178 | AK022710 | Homo sapiens unnamed protein product | 527 | 100 |
| 179 | D50617 | Saccharomyces cerevisiae YFL027C | 139 | 28 |
| 180 | AF065389 | Homo sapiens tetraspan NET-4 | 867 | 59 |
| 181 | D21261 | Homo sapiens similar to human 22kDa, SM22 mRNA (HUM22SM). | 1048 | 100 |
| 182 | AL162971 | Arabidopsis thaliana putative protein | 529 | 38 |
| 183 | AL080062 | Homo sapiens hypothetical protein | 1530 | 99 |
| 184 | U93572 | Homo sapiens putative p150 | 496 | 53 |
| 185 | AF187064 | Homo sapiens p75NTR-associated cell death executor; NADE | 227 | 47 |
| 186 | AL035413 | Homo sapiens dJ657E11.5 (KIAA0090 PROTEIN) | 1880 | 99 |
| 187 | AC073944 | Arabidopsis thaliana ethylene-responsive RNA helicase, putative | 755 | 36 |
| 188 | AB017615 | Mus musculus Eos protein | 2750 | 95 |
| 189 | Z99110 | Bacillus subtilis similar to hexuronate transporter | 148 | 20 |
| 190 | AL138657 | Arabidopsis thaliana putative protein | 253 | 32 |
| 191 | AJ002397 | Trichoderma harzianum beta-1, 3 exoglucanase | 177 | 30 |
| 192 | AY004877 | Mus musculus cytoplasmic dynein heavy chain | 5569 | 98 |
| 193 | U02313 | Mus musculus protein kinase | 6356 | 86 |
| 194 | AE003739 | Drosophila melanogaster CG6949 gene product | 596 | 43 |
| 195 | U01317 | Homo sapiens epsilon-globin | 397 | 100 |
| 196 | AF083116 | Homo sapiens paraneoplastic cancer-testis-brain antigen | 770 | 46 |
| 197 | AL133156 | Schizosaccharomyces pombe putative U4/U6 small nuclear ribonucleoprotein | 157 | 27 |
| 198 | AF123653 | Homo sapiens FEZ1 | 742 | 42 |
| 199 | Z99162 | Schizosaccharomyces pombe putative signal transduction pathway protein | 167 | 24 |
| 200 | U10406 | Mus musculus capping protein beta-subunit, isoform 1 | 1440 | 98 |
| 201 | AL365409 | Homo sapiens similar to (NP_034322.1 \|) sex-determination protein homolog Fem1a | 1653 | 100 |
| 202 | AF116656 | Homo sapiens PRO1167 | 389 | 100 |
| 203 | AL161578 | Arabidopsis thaliana putative protein | 142 | 27 |
| 204 | AF148805 | Kaposi's sarcoma-associated herpesvirus latent nuclear antigen | 172 | 21 |

TABLE 2-continued

| SEQ ID NO: | ACCESSION NUMBER | DESCRIPTION | SMITH-WATERMAN SCORE | % IDENTITY |
|---|---|---|---|---|
| 205 | AF102853 | *Rattus norvegicus* membrane-associated guanylate kinase-interacting protein 1 Maguin-1 | 1500 | 62 |
| 206 | AF102853 | *Rattus norvegicus* membrane-associated guanylate kinase-interacting protein 1 Maguin-1 | 779 | 69 |
| 207 | AF102853 | *Rattus norvegicus* membrane-associated guanylate kinase-interacting protein 1 Maguin-1 | 933 | 71 |
| 208 | AF096896 | *Drosophila melanogaster* Pushover | 2089 | 50 |
| 209 | AF178941 | *Homo sapiens* ATP-binding cassette sub-family A member 2 | 9833 | 99 |
| 210 | AC004780 | *Homo sapiens* F17127_1 | 1262 | 95 |
| 211 | AL121845 | *Homo sapiens* dJ583P15.5.1 (novel protein (isoform 1)) | 1774 | 99 |
| 212 | AF170562 | *Homo sapiens* ubiquitin-specific processing protease | 1248 | 49 |
| 213 | U00060 | *Saccharomyces cerevisiae* Yhr088wp | 637 | 46 |
| 214 | AJ289133 | *Mus musculus* chondroitin 4-O-sulfotransferase | 565 | 42 |
| 215 | M63577 | *Saccharomyces cerevisiae* SFP1 | 131 | 59 |
| 216 | AB046635 | *Macaca fascicularis* hypothetical protein | 300 | 46 |
| 217 | Z98884 | *Homo sapiens* dJ467L1.1 (KIAA0833) | 3640 | 99 |
| 218 | AB009883 | *Nicotiana tabacum* KED | 203 | 22 |
| 219 | D86491 | *Xenopus laevis* Nfr1 | 2416 | 75 |
| 220 | U66707 | *Rattus norvegicus* densin-180 | 3640 | 93 |
| 221 | AJ006701 | *Homo sapiens* putative serine/threonine protein kinase | 1457 | 84 |
| 222 | X61045 | *Hydra sp.* mini-collagen | 132 | 62 |
| 223 | AF138883 | *Bos taurus* type II collogen cyanogen bromide fragment CB10 | 170 | 38 |
| 224 | U22816 | *Homo sapiens* LAR-interacting protein 1b | 2039 | 57 |
| 225 | AL109865 | *Homo sapiens* bG120K12.3.1 (novel protein similar to archaeal, yeast and worm N2,N2-dimethylguanosine tRNA methyltransferase (isoform 1)) | 2298 | 98 |
| 226 | AJ011654 | *Homo sapiens* triple LIM domain protein | 557 | 41 |
| 227 | AB030198 | *Mus musculus* contains transmembrane (TM) region | 318 | 50 |
| 229 | AF233223 | *Homo sapiens* F-box protein FBG2 | 1386 | 87 |
| 230 | D88734 | Equine herpesvirus 1 membrane glycoprotein | 333 | 28 |
| 231 | X94699 | *Mesocricetus auratus* glucosamine-6-phosphate isomerase | 1306 | 87 |
| 232 | AL358732 | *Arabidopsis thaliana* putative protein | 385 | 44 |
| 233 | AB004306 | *Homo sapiens* osteoblast stimulating factor-1 | 574 | 100 |
| 234 | Z99281 | *Caenorhabditis elegans* Y57G11C.17 | 154 | 22 |

TABLE 2-continued

| SEQ ID NO: | ACCESSION NUMBER | DESCRIPTION | SMITH-WATERMAN SCORE | % IDENTITY |
|---|---|---|---|---|
| 235 | U23181 | *Caenorhabditis elegans* final exon in repeat region; similar to long tandem repeat region of sialidase (SP: TCNA_TRYCR, P23253) and neurofilament H protein | 173 | 26 |
| 236 | X99384 | *Mus musculus* paladin | 3563 | 80 |
| 237 | AB020755 | *Arabidopsis thaliana* | 144 | 32 |
| 238 | AF168122 | *Oryctolagus cuniculus* hyperpolarization-activated cyclic nucleotide-gated channel 1 | 4053 | 96 |
| 239 | AF177909 | *Homo sapiens* TTYH1 | 1055 | 100 |
| 240 | AF265296 | *Drosophila melanogaster* putative multipass transmembrane | 647 | 48 |
| 241 | AC024760 | *Caenorhabditis elegans* contains similarity to TR: Q10466 | 212 | 19 |
| 242 | AB034991 | *Mus musculus* stress protein Herp | 614 | 37 |
| 243 | AF030558 | *Rattus norvegicus* phosphatidylinositol 5-phosphate 4-kinase gamma | 2090 | 95 |
| 244 | M80537 | *Drosophila melanogaster* fat protein | 1610 | 30 |
| 245 | U80741 | *Homo sapiens* CAGH44 | 373 | 56 |
| 246 | L11586 | *Rattus norvegicus* leukocyte common antigen-related phosphatase | 271 | 25 |
| 247 | AF265555 | *Homo sapiens* ubiquitin-conjugating BIR-domain enzyme APOLLON | 330 | 37 |
| 248 | AC024810 | *Caenorhabditis elegans* contains similarity to Pfam family PF00560 (Leucine Rich Repeat-2 copies) | 450 | 35 |
| 249 | U13831 | *Homo sapiens* cellular retinol binding protein II | 715 | 99 |
| 250 | J03799 | *Homo sapiens* laminin-binding protein | 209 | 87 |
| 251 | AL109840 | *Homo sapiens* dJ543J19.4 (A novel protein (ortholog of chicken tubulin beta-6 chain (beta-tubulin class-VI))) | 1447 | 100 |
| 252 | AL109840 | *Homo sapiens* dJ543J19.4 (A novel protein (ortholog of chicken tubulin beta-6 chain (beta-tubulin class-VI))) | 1842 | 100 |
| 253 | D14710 | *Homo sapiens* inport precursor of human ATP synthase alpha subunit | 1566 | 99 |
| 254 | Y07895 | Strongylocentrotus purpuratus mitochondrial ATP synthase alpha subunit precursor | 815 | 78 |
| 255 | AJ243936 | *Homo sapiens* protein G16 | 592 | 60 |
| 256 | AL034380 | *Homo sapiens* dJ50O24.1 (novel protein similar to *C. elegans* K07B1.7 (Tr: O01886) | 1262 | 100 |
| 257 | D17409 | *Homo sapiens* SM22 alpha | 937 | 95 |
| 258 | AL080276 | *Homo sapiens* dJ101K10.1 (novel protein similar to Prokaryotic-type | 1940 | 99 |

TABLE 2-continued

| SEQ ID NO: | ACCESSION NUMBER | DESCRIPTION | SMITH-WATERMAN SCORE | % IDENTITY |
|---|---|---|---|---|
| | | class I peptide chain release factors) | | |
| 259 | AL080276 | Homo sapiens dJ101K10.1 (novel protein similar to Prokaryotic-type class I peptide chain release factors) | 1048 | 99 |
| 260 | D50617 | Saccharomyces cerevisiae YFL044C | 352 | 32 |
| 261 | D63378 | Rattus norvegicus ER-60 protease | 174 | 28 |
| 262 | AJ249900 | Homo sapiens secreted modular calcium-binding protein | 2346 | 99 |
| 263 | U41557 | Caenorhabditis elegans proline and glycine-rich | 281 | 33 |
| 264 | AE001751 | Thermotoga maritima dnaJ protein | 172 | 52 |
| 265 | AC004144 | Homo sapiens R34001_1 | 1699 | 89 |
| 266 | AF221759 | Homo sapiens Mam1 | 342 | 31 |
| 267 | U33007 | Saccharomyces cerevisiae Ydr438wp; CAI: 0.11 | 370 | 35 |
| 268 | X15940 | Homo sapiens ribosomal protein L31 (AA 1–125) | 546 | 92 |
| 269 | X00955 | Homo sapiens prepro-apo AII | 478 | 96 |
| 270 | AL035460 | Homo sapiens dJ860F19.3 (novel protein (ortholog of mouse metallocarboxypeptidase CPX-1)) | 3571 | 100 |
| 271 | U35730 | Mus musculus jerky | 758 | 33 |
| 272 | X16576 | Homo sapiens KUP protein | 567 | 37 |
| 273 | AK021815 | Homo sapiens unnamed protein product | 1408 | 97 |
| 274 | AL391148 | Arabidopsis thaliana putative protein | 521 | 43 |
| 275 | AL391148 | Arabidopsis thaliana putative protein | 521 | 43 |
| 276 | U33335 | Saccharomyces cerevisiae Lpa8p | 376 | 29 |
| 277 | AB046381 | Homo sapiens testis-abundant finger protein | 2739 | 100 |
| 278 | Z19092 | Oryctolagus cuniculus trichohyalin | 217 | 25 |
| 279 | U65079 | Mus musculus actin-binding protein | 516 | 26 |
| 280 | M27878 | Homo sapiens DNA binding protein | 1491 | 56 |
| 281 | U62907 | Mus musculus zinc finger protein 95 | 675 | 36 |
| 282 | AF052298 | Drosophila silvestris Y box protein | 140 | 34 |
| 283 | AB020970 | Homo sapiens up-regulated by BCG-CWS | 637 | 100 |
| 284 | X61585 | Bos taurus polynucleotide adenylyltransferase | 2194 | 60 |
| 285 | AJ249978 | Xenopus laevis p33 ringo | 95 | 43 |
| 286 | U96166 | Streptococcus cristatus srpA | 194 | 17 |
| 287 | AE003701 | Drosophila melanogaster CG9591 gene product | 286 | 29 |
| 288 | AL117337 | Homo sapiens bA393J16.3 (novel KRAB box containing zinc finger gene) | 2015 | 100 |
| 289 | AC004076 | Homo sapiens R30217_1 | 1793 | 56 |
| 290 | M27337 | Homo sapiens T cell receptor gamma chain | 399 | 91 |
| 291 | V00507 | Homo sapiens coding sequence of DHFR (1 is 1st base in codon) (561 is 3rd base in codon) | 886 | 93 |
| 292 | AE005053 | Halobacterium sp. NRC-1 Vng1303c | 1062 | 37 |

TABLE 2-continued

| SEQ ID NO: | ACCESSION NUMBER | DESCRIPTION | SMITH-WATERMAN SCORE | % IDENTITY |
|---|---|---|---|---|
| 293 | AF061258 | *Homo sapiens* LIM protein | 510 | 88 |
| 294 | AE003543 | *Drosophila melanogaster* CG6938 gene product | 142 | 60 |
| 295 | AK024429 | *Homo sapiens* FLJ00018 protein | 5938 | 100 |
| 296 | AF151851 | *Homo sapiens* CGI-93 protein | 557 | 49 |
| 297 | AK025429 | *Homo sapiens* unnamed protein product | 668 | 63 |
| 298 | Z19092 | *Oryctolagus cuniculus* trichohyalin | 188 | 21 |
| 299 | AF195056 | *Mus musculus* SorCSb splice variant of the VPS10 domain receptor SorCS | 2188 | 47 |
| 300 | L32978 | *Mesocricetus auratus* synaptonemal complex protein | 167 | 22 |
| 301 | AC002130 | *Arabidopsis thaliana* F1N21.22 | 237 | 30 |
| 302 | U80736 | *Homo sapiens* CAGF9 | 290 | 87 |
| 303 | AF178428 | *Bos taurus* submaxillary mucin | 183 | 26 |
| 304 | AJ243936 | *Homo sapiens* protein G16 | 380 | 68 |
| 305 | AF147791 | *Homo sapiens* mucin 11 | 106 | 22 |
| 306 | AF071010 | Mouse mammary tumor virus putative integrase | 177 | 46 |
| 307 | X71997 | *Rattus norvegicus* myosin I | 1654 | 62 |
| 308 | AF000560 | *Homo sapiens* TTF-I interacting peptide 20; TIP20; Transcription Termination Factor I Interacting Peptide 20 | 2081 | 99 |
| 309 | AF142780 | *Mus musculus* butyrophilin-like protein | 895 | 69 |
| 310 | AF161384 | *Homo sapiens* HSPC266 | 119 | 44 |
| 311 | A08695 | *Homo sapiens* rap2 | 204 | 31 |
| 312 | X04956 | *Homo sapiens* T-cell receptor alpha-chain (404 is 2nd base in codon) | 590 | 100 |
| 313 | X60489 | *Homo sapiens* elongation factor-1-beta | 1066 | 92 |
| 314 | AB026190 | *Homo sapiens* Kelch motif containing protein | 1187 | 44 |
| 315 | U66561 | *Homo sapiens* kruppel-related zinc finger protein | 916 | 45 |
| 316 | AF038007 | *Homo sapiens* FIC1 | 1499 | 54 |
| 317 | AJ225124 | *Mus musculus* hyperpolarization-activated cation channel, HAC3 | 3554 | 96 |
| 318 | AL031788 | *Schizosaccharomyces pombe* putative mitochondrial membrane protease subunit 2 | 290 | 40 |
| 319 | AC003682 | *Homo sapiens* F18547_1 | 814 | 49 |
| 320 | AF188507 | *Mus musculus* LAB300 isoform gamma | 1347 | 46 |
| 321 | AL136125 | *Homo sapiens* dJ304B14.1 (novel protein) | 374 | 32 |
| 322 | U70312 | *Homo sapiens* integrin binding protein Del-1 | 447 | 100 |
| 323 | D13302 | *Megabalanus rosa* lectin BRA-3 | 155 | 30 |
| 324 | U59185 | *Homo sapiens* putative monocarboxylate transporter | 519 | 29 |
| 325 | AF205599 | *Mus musculus* transposase-like protein | 1016 | 35 |
| 326 | Z34465 | *Zea mays* extensin-like protein | 218 | 27 |

TABLE 2-continued

| SEQ ID NO: | ACCESSION NUMBER | DESCRIPTION | SMITH-WATERMAN SCORE | % IDENTITY |
|---|---|---|---|---|
| 327 | AL049553 | *Homo sapiens* dJ402N21.2 (novel protein with MAM domain) | 1474 | 100 |
| 328 | AF027505 | *Mus musculus* putative membrane-associated guanylate kinase 1 | 1118 | 83 |
| 329 | U37376 | *Xenopus laevis* MAM domain protein | 2448 | 63 |
| 330 | AF030430 | *Mus musculus* semaphorin VIa | 2958 | 94 |
| 331 | Z30174 | *Mus musculus domesticus* zinc finger protein 30 | 2087 | 71 |
| 332 | U55020 | *Saccharomyces cerevisiae* Smp3p | 282 | 33 |
| 333 | Y07783 | *Rattus norvegicus* ER transmembrane protein | 285 | 32 |
| 334 | AF291437 | *Rattus norvegicus* neuronal leucine-rich repeat protein-3 | 432 | 27 |
| 335 | W56097 | *Homo sapiens* amino acid sequence of the ODD4b5.3 enzyme | 2470 | 84 |
| 336 | AB029333 | *Halocynthia roretzi* HrPET-1 | 810 | 44 |
| 337 | AB030186 | *Mus musculus* unnamed protein product | 1634 | 86 |
| 338 | AB030186 | *Mus musculus* unnamed protein product | 1671 | 89 |
| 339 | AF128113 | *Mus musculus* prominin-like protein | 1021 | 77 |
| 340 | AB007407 | *Mus musculus* myeloid zinc finger protein-2 | 209 | 43 |
| 341 | AF176665 | *Xenopus laevis* F-box protein 27 | 249 | 29 |
| 342 | AL079335 | *Homo sapiens* dJ132F21.2 (Contains a novel protein similar to the L82E from Drosophila) | 352 | 56 |
| 343 | AF177377 | *Homo sapiens* cytoplasmic protein | 628 | 62 |
| 344 | AF002109 | *Arabidopsis thaliana* putative ABC transporter | 371 | 31 |
| 345 | AJ010482 | *Homo sapiens* Myopodin protein | 579 | 29 |
| 346 | X01831 | *Cairina moschata* alpha D-globin | 398 | 53 |
| 347 | X01831 | *Cairina moschata* alpha D-globin | 314 | 54 |
| 348 | AL163852 | *Arabidopsis thaliana* putative protein | 184 | 53 |
| 349 | AF176532 | *Mus musculus* F-box protein FBX17 | 706 | 59 |
| 350 | D83674 | *Mus musculus* MesP1 | 564 | 65 |
| 351 | AC006539 | *Homo sapiens* BC39498_3 | 387 | 100 |
| 352 | AF229643 | *Mus musculus* ubiquitin specific protease | 2025 | 73 |
| 353 | X17025 | *Homo sapiens* homologue of yeast IPP isomerase | 808 | 64 |
| 354 | D79983 | *Homo sapiens* There is a C3HC4 zinc-finger in the C-terminal region. | 659 | 52 |
| 355 | D79983 | *Homo sapiens* There is a C3HC4 zinc-finger in the C-terminal region. | 434 | 44 |
| 356 | AF109674 | *Rattus norvegicus* late gestation lung protein 1 | 968 | 86 |
| 357 | AC004780 | *Homo sapiens* F17127_1 | 1258 | 87 |
| 358 | X76116 | *Caenorhabditis elegans* carrier protein (c2) | 567 | 48 |
| 359 | X77953 | *Rattus norvegicus* ribosomal protein S15a | 671 | 100 |
| 360 | U67594 | *Methanococcus jannaschii* Yeast KTI12 Protein | 171 | 27 |
| 361 | AF229643 | *Mus musculus* ubiquitin specific protease | 2711 | 95 |

TABLE 2-continued

| SEQ ID NO: | ACCESSION NUMBER | DESCRIPTION | SMITH-WATERMAN SCORE | % IDENTITY |
|---|---|---|---|---|
| 362 | AF083340 | *Homo sapiens* double-stranded RNA-binding zinc finger protein JAZ | 270 | 54 |
| 363 | AE000161 | *Escherichia coli* K12 bacteriophage lambda lysozyme homolog | 296 | 59 |
| 364 | AL023705 | *Schizosaccharomyces pombe* phenylalanyl-trna synthetase, mitochondrial precursor | 241 | 33 |
| 365 | J02870 | *Mus musculus* laminin receptor | 321 | 64 |
| 366 | AL137391 | *Homo sapiens* hypothetical protein | 1620 | 100 |
| 367 | AB012247 | *Arabidopsis thaliana* contains similarity to zinc finger proteins~gene_id: MSL1.13 | 732 | 42 |
| 368 | AF167441 | *Mus musculus* E-cadherin binding protein E7 | 2768 | 97 |
| 369 | AF196576 | *Chlamydomonas reinhardtii* flagellar protofilament ribbon protein | 260 | 34 |
| 370 | AF075050 | *Homo sapiens* similar to (AJ223828) small glutamine-rich tetratricopeptide (SGT) | 592 | 100 |
| 371 | S79410 | *Mus musculus* nuclear localization signal binding protein | 107 | 51 |
| 372 | AC015446 | *Arabidopsis thaliana* Similar to AIG1 protein | 311 | 34 |
| 373 | AF217227 | *Homo sapiens* zinc finger protein ZNF287 | 1187 | 52 |
| 374 | AB013390 | *Arabidopsis thaliana* ADP-ribosylation factor-like protein | 605 | 66 |
| 375 | AB026842 | *Mus musculus* sialidase | 732 | 51 |
| 376 | D78174 | *Mus musculus* Zic4 protein | 1490 | 86 |
| 377 | X51394 | *Xenopus laevis* APEG precursor protein | 186 | 26 |
| 378 | AJ001616 | *Mus musculus* myeloid associated differentiation protein | 1106 | 86 |
| 379 | AF248651 | *Homo sapiens* RNA-binding protein BRUNOL4 | 869 | 100 |
| 380 | U16800 | *Xenopus laevis* ribonucleoprotein | 764 | 72 |
| 381 | AE003503 | *Drosophila melanogaster* CG4768 gene product | 249 | 32 |
| 383 | AB026192 | *Xenopus laevis* Kielin | 413 | 36 |
| 384 | Y16430 | *Mus musculus* ribosomal protein L35a | 201 | 54 |
| 385 | Z46259 | *Saccharomyces cerevisiae* NO381 | 169 | 40 |
| 386 | AF136010 | Solanum chacoense SPP30 | 437 | 51 |
| 387 | AK024432 | *Homo sapiens* FLJ00022 protein | 1346 | 93 |
| 388 | AB004665 | *Mus musculus* Rab33B | 1138 | 94 |
| 389 | AF053768 | *Rattus norvegicus* brain specific cortactin-binding protein CBP90 | 589 | 36 |
| 390 | M20030 | *Homo sapiens* small proline rich protein | 434 | 94 |
| 391 | AF182443 | *Rattus norvegicus* F-box protein FBL2 | 1449 | 99 |
| 392 | U53449 | *Rattus norvegicus* jun dimerization protein 2 | 800 | 96 |
| 393 | AB046381 | *Homo sapiens* testis-abundant finger protein | 270 | 36 |
| 394 | AL031588 | *Homo sapiens* dJ1163J1.2 (novel protein similar to *C. elegans* B0035.16 | 863 | 100 |

TABLE 2-continued

| SEQ ID NO: | ACCESSION NUMBER | DESCRIPTION | SMITH-WATERMAN SCORE | % IDENTITY |
|---|---|---|---|---|
| | | and bacterial tRNA (5-Methylaminomethyl-2-thiouridylate)-Methyltransferases) | | |
| 395 | AF117814 | *Mus musculus* odd-skipped related 1 protein | 1413 | 97 |
| 396 | AJ010228 | *Homo sapiens* RFPL1L | 889 | 58 |
| 397 | U65079 | *Mus musculus* actin-binding protein | 2402 | 74 |
| 398 | M64488 | *Rattus norvegicus* synaptotagmin II | 2128 | 95 |
| 399 | AB017026 | *Mus musculus* oxysterol-binding protein | 548 | 99 |
| 400 | U42580 | *Paramecium bursaria* Chlorella virus 1 contains 10 ankyrin-like repeats; similar to human ankyrin, corresponds to Swiss-Prot Accession Number P16157 | 213 | 33 |
| 401 | Y00204 | *Xenopus laevis* nucleoplasmin | 464 | 49 |
| 402 | U80741 | *Homo sapiens* CAGH44 | 446 | 65 |
| 403 | D16100 | *Rattus norvegicus* 90 kDa-diacylglycerol kinase | 4055 | 95 |
| 404 | AF132611 | *Homo sapiens* monocarboxylate transporter MCT3 | 268 | 49 |
| 405 | AB030505 | *Mus musculus* UBE-1c2 | 661 | 50 |
| 406 | AK024422 | *Homo sapiens* FLJ00011 protein | 1450 | 97 |
| 407 | AC007228 | *Homo sapiens* BC37295_1 | 576 | 49 |
| 408 | AB017059 | *Arabidopsis thaliana* FH protein interacting protein FIP2 | 183 | 43 |
| 409 | L06434 | *Rattus sp.* neurotransmitter transporter | 3709 | 96 |
| 410 | AB017139 | *Rattus norvegicus* Kilon | 667 | 94 |
| 411 | AF088982 | *Homo sapiens* heat shock protein hsp40-3 | 478 | 49 |
| 412 | L04948 | *Saccharomyces cerevisiae* mitochondrial transporter protein | 467 | 37 |
| 413 | U09413 | *Homo sapiens* zinc finger protein ZNF135 | 1241 | 52 |
| 414 | X58079 | *Homo sapiens* S100 alpha protein | 274 | 57 |
| 415 | X61617 | *Drosophila melanogaster* neuralized protein | 183 | 38 |
| 416 | AF176694 | *Mus musculus* neighbor of Punc e11 protein | 344 | 41 |
| 417 | AC002086 | *Homo sapiens* similar to zinc finger 5 protein from *Gallus gallus*, U51640 (PID: g1399185) | 346 | 41 |
| 418 | AB046381 | *Homo sapiens* testis-abundant finger protein | 564 | 43 |
| 419 | AF086824 | *Mus musculus* rho/rac-interacting citron kinase | 1506 | 89 |
| 420 | AE000663 | *Mus musculus* trypsinogen 1 | 898 | 65 |
| 421 | L20468 | *Rattus norvegicus* cerebroglycan | 1132 | 87 |
| 422 | X73462 | *Ovis aries* hair keratin cysteine rich protein | 198 | 39 |
| 423 | AC002394 | *Homo sapiens* Gene product with similarity to dynein beta subunit | 3043 | 100 |
| 424 | AF118566 | *Mus musculus* hematopoietic zinc finger protein | 722 | 48 |
| 425 | AJ010100 | *Homo sapiens* NKp44RG2 | 163 | 30 |
| 426 | AF059576 | *Mus musculus* myosin binding protein-C | 264 | 26 |

TABLE 2-continued

| SEQ ID NO: | ACCESSION NUMBER | DESCRIPTION | SMITH-WATERMAN SCORE | % IDENTITY |
|---|---|---|---|---|
| 427 | M37760 | *Mus musculus* serine 2 ultra high sulfur protein | 461 | 41 |
| 428 | AL359916 | *Homo sapiens* bA550O8.2 (A novel protein similar to cell division protein kinase 4 (CDK4)) | 1734 | 99 |
| 429 | X68527 | *Homo sapiens* TCR Vbeta 5.5 | 613 | 94 |
| 430 | AJ006078 | *Homo sapiens* beta-1,3-galactosyltransferase | 373 | 34 |
| 431 | AF059493 | *Sus scrofa* proteasome subunit LMP7 | 618 | 53 |
| 432 | AL096770 | *Homo sapiens* bA150A6.2 (novel 7 transmembrane receptor (rhodopsin family) (olfactory receptor like) protein (hs6M1-21)) | 816 | 52 |
| 433 | U38896 | *Homo sapiens* zinc finger protein C2H2-171 | 501 | 62 |
| 434 | AF093680 | *Homo sapiens* transcription factor IIB | 157 | 26 |
| 435 | AJ237660 | Bacteriophage 21 NinG protein | 392 | 43 |
| 436 | L10912 | *Oryctolagus cuniculus* cytochrome P-450 2B-Bx | 1317 | 51 |
| 437 | AL031055 | *Homo sapiens* dJ28H20.1 (novel protein similar to membrane transport proteins) | 2624 | 99 |
| 438 | AJ007421 | *Homo sapiens* spalt-like zinc finger protein | 6070 | 99 |
| 439 | X94744 | *Gallus gallus* olfactory receptor 4 | 443 | 45 |
| 440 | AB037973 | *Homo sapiens* FGF-23 | 1360 | 100 |
| 441 | X13986 | *Mus musculus* minopontin precursor (AA-66 to 272) | 1521 | 100 |

TABLE 3

| SEQ ID NO: | ACCESSION NO. | DESCRIPTION | RESULTS* |
|---|---|---|---|
| 1 | PF00642 | Zinc finger C-x8-C-x5-C-x3-H type (and similar). | PF00642 11.59 9.700e−12 426−437 |
| 2 | BL00291 | Prion protein. | BL00291A 4.49 8.759e−09 185−220 |
| 3 | PR00405 | HIV REV INTERACTING PROTEIN SIGNATURE | PR00405B 11.83 7.000e−21 49−67<br>PR00405A 17.71 6.943e−13 30−50<br>PR00405C 19.41 4.906e−12 70−92 |
| 4 | PF01105 | emp24/gp25L/p24 family. | PF01105B 25.12 1.000e−40 178−230 |
| 5 | BL00307 | Legume lectins beta-chain proteins. | BL00307G 9.91 8.531e−10 678−689 |
| 7 | BL01159 | WW/rsp5/WWP domain proteins. | BL01159 13.85 6.073e−09 61−76 |
| 8 | BL01159 | WW/rsp5/WWP domain proteins. | BL01159 13.85 6.073e−09 61−76 |
| 10 | BL00913 | Iron-containing alcohol dehydrogenases proteins. | BL00913D 24.20 8.981e−17 170−204<br>BL00913C 7.62 4.375e−11 136−146<br>BL00913B 10.94 7.706e−11 86−102 |
| 11 | BL00913 | Iron-containing alcohol dehydrogenases proteins. | BL00913D 24.20 8.981e−17 218−252<br>BL00913C 7.62 4.375e−11 184−194<br>BL00913B 10.94 7.706e−11 134−150 |
| 12 | BL50062 | BCL2-like apoptosis inhibitors (spans part of BH3, BH1 and BH | BL50062C 6.66 8.500e−11 349−358 |

TABLE 3-continued

| SEQ ID NO: | ACCESSION NO. | DESCRIPTION | RESULTS* |
|---|---|---|---|
| 15 | BL01144 | Ribosomal protein L31e proteins. | BL01144 25.07 9.069e−26 78−130 |
| 16 | PF00642 | Zinc finger C-x8-C-x5-C-x3-H type (and similar). | PF00642 11.59 6.694e−10 355−366 |
| 18 | PR00773 | GRPE PROTEIN SIGNATURE | PR00773D 16.14 5.922e−09 215−235 |
| 24 | PD00930 | PROTEIN GTPASE DOMAIN ACTIVATION. | PD00930B 33.72 7.300e−26 600−641<br>PD00930A 25.62 1.514e−16 497−523 |
| 26 | BL00375 | UDP-glycosyltransferases proteins. | BL00375F 16.99 7.061e−35 291−336<br>BL00375C 18.27 2.615e−19 126−150<br>BL00375D 14.56 9.000e−17 192−220<br>BL00375B 21.22 8.627e−16 67−108<br>BL00375G 13.01 4.577e−13 390−430 |
| 29 | BL01170 | Ribosomal protein L6e proteins. | BL01170A 12.34 9.143e−40 139−175 |
| 30 | BL00359 | Ribosomal protein L11 proteins. | BL00359B 23.07 4.231e−24 56−97<br>BL00359C 22.18 6.586e−22 111−145<br>BL00359A 20.66 4.000e−21 20−56 |
| 31 | PR00983 | CYSTEINYL-TRNA SYNTHETASE SIGNATURE | PR00983D 14.16 3.647e−23 270−292<br>PR00983C 11.27 3.415e−21 239−258<br>PR00983A 11.10 1.878e−12 75−87 |
| 32 | PR00718 | PHOSPHOLIPASE D SIGNATURE | PR00718E 8.61 1.000e−08 327−351 |
| 33 | BL00518 | Zinc finger, C3HC4 type (RING finger), proteins. | BL00518 12.23 6.571e−10 49−58 |
| 34 | PF00992 | Troponin. | PF00992A 16.67 7.972e−10 10−45<br>PF00992A 16.67 5.145e−09 17−52<br>PF00992A 16.67 6.684e−09 56−91 |
| 35 | PR00452 | SH3 DOMAIN SIGNATURE | PR00452D 17.02 8.000e−11 252−265 |
| 36 | BL01019 | ADP-ribosylation factors family proteins. | BL01019A 13.20 8.000e−11 68−108 |
| 39 | PR00764 | COMPLEMENT C9 SIGNATURE | PR00764F 16.89 7.783e−11 204−225 |
| 40 | PR00832 | PAXILLIN SIGNATURE | PR00832B 9.87 6.284e−10 768−792 |
| 42 | BL00226 | Intermediate filaments proteins. | BL00226D 19.10 3.172e−34 397−444<br>BL00226B 23.86 5.929e−23 230−278<br>BL00226C 13.23 4.808e−21 296−327<br>BL00226A 12.77 5.065e−13 129−144<br>BL00226B 23.86 6.400e−10 181−229 |
| 43 | BL00243 | Integrins beta chain cysteine-rich domain proteins. | BL00243I 31.77 2.014e−09 156−199<br>BL00243I 31.77 5.437e−09 159−202<br>BL00243I 31.77 5.690e−09 30−73 |
| 45 | BL00291 | Prion protein. | BL00291A 4.49 4.414e−09 47−82 |
| 46 | PF00084 | Sushi domain proteins (SCR repeat proteins. | PF00084B 9.45 7.188e−10 1549−1561 |
| 47 | BL00414 | Profilin proteins. | BL00414D 15.59 9.182e−10 81−108 |
| 50 | PR00837 | ALLERGEN V5/TPX-1 FAMILY SIGNATURE | PR00837D 11.12 6.023e−09 22−36 |
| 51 | BL00284 | Serpins proteins. | BL00284A 15.64 2.350e−20 85−109<br>BL00284D 16.34 4.240e−19 323−350<br>BL00284C 28.56 5.600e−17 216−258<br>BL00284E 19.15 7.500e−14 408−433<br>BL00284B 17.99 9.379e−13 189−210 |
| 52 | BL01283 | T-box domain proteins. | BL01283A 24.15 2.125e−39 148−196<br>BL01283B 23.17 9.438e−34 208−250<br>BL01283D 11.70 7.868e−31 298−331<br>BL01283C 13.05 8.448e−16 260−274 |
| 53 | PD01270 | RECEPTOR FC IMMUNOGLOBULIN AFFIN. | PD01270D 24.66 8.054e−09 50−86 |
| 54 | BL00237 | G-protein coupled receptors proteins. | BL00237A 27.68 2.543e−13 181−221 |
| 55 | PR00050 | COLD SHOCK PROTEIN SIGNATURE | PR00050A 11.28 3.143e−12 42−58<br>PR00050C 9.82 9.151e−11 85−104 |
| 58 | BL01173 | Lipolytic enzymes G-D-X-G family, histidine. | BL01173B 13.27 4.462e−17 140−167<br>BL01173C 8.98 4.349e−14 182−196<br>BL01173A 9.41 1.818e−13 454−467<br>BL01173C 8.98 6.553e−13 495−509<br>BL01173A 9.41 8.364e−13 107−120 |
| 59 | PR00321 | GAMMA G-PROTEIN (TRANSDUCIN) SIGNATURE | PR00321C 15.39 2.473e−12 123−141 |

TABLE 3-continued

| SEQ ID NO: | ACCESSION NO. | DESCRIPTION | RESULTS* |
|---|---|---|---|
| 60 | PR00937 | T-BOX DOMAIN SIGNATURE | PR00937A 15.25 1.000e−24 117−142<br>PR00937D 13.41 5.500e−18 220−235<br>PR00937B 14.58 5.235e−13 184−198<br>PR00937F 12.53 1.450e−12 293−302<br>PR00937E 11.86 1.918e−12 259−273<br>PR00937C 10.51 3.571e−11 201−211 |
| 61 | PD02059 | CORE POLYPROTEIN PROTEIN GAG CONTAINS: P. | PD02059A 28.10 2.694e−09 116−157 |
| 65 | BL00634 | Ribosomal protein L30 proteins. | BL00634 34.38 3.250e−15 46−97 |
| 66 | BL00226 | Intermediate filaments proteins. | BL00226B 23.86 1.643e−31 264−312 |
| 70 | DM00892 | 3 RETROVIRAL PROTEINASE. | DM00892C 23.55 6.727e−13 33−67 |
| 71 | PR00874 | FUNGI-IV METALLOTHIONEIN SIGNATURE | PR00874C 4.37 7.652e−10 68−83 |
| 72 | PR00102 | ORNITHINE CARBAMOYLTRANSFERASE SIGNATURE | PR00102C 15.77 1.988e−07 42−57 |
| 73 | PR00359 | B-CLASS P450 SIGNATURE | PR00359D 16.13 6.824e−08 291−314 |
| 74 | PR00066 | XERODERMA PIGMENTOSUM GROUP G PROTEIN SIGNATURE | PR00066A 10.61 6.418e−08 77−95 |
| 75 | PR00873 | ECHINOIDEA (SEA URCHIN) METALLOTHIONEIN SIGNATURE | PR00873D 8.43 8.237e−08 13−32 |
| 76 | PR00623 | HISTONE H4 SIGNATURE | PR00623B 13.68 8.888e−09 364−384 |
| 77 | BL00873 | Sodium: alanine symporter family proteins. | BL00873E 24.91 2.800e−07 216−257 |
| 78 | PR00478 | PHOSPHORIBULOKINASE FAMILY SIGNATURE | PR00478C 12.84 5.012e−07 102−120 |
| 79 | PF00878 | Cation-independent mannose-6-phosphate receptor repeat proteins. | PF00878T 17.51 5.457e−08 52−79 |
| 80 | PR00715 | CATION-DEPENDENT MANNOSE-6-PHOSPHATE RECEPTOR SIGNATURE | PR00715I 10.58 3.603e−06 112−131 |
| 81 | PR00350 | VITAMIN D RECEPTOR SIGNATURE | PR00350E 11.55 6.780e−07 45−65 |
| 82 | BL01131 | Ribosomal RNA adenine dimethylases proteins. | BL01131A 26.62 2.376e−08 460−506 |
| 83 | PR00629 | SHC PHOSPHOTYROSINE INTERACTION DOMAIN SIGNATURE | PR00629F 10.95 9.457e−07 96−123 |
| 84 | BL00111 | Phosphoglycerate kinase proteins. | BL00111A 9.65 7.783e−07 73−87 |
| 88 | PD00066 | PROTEIN ZINC-FINGER METAL-BINDI | PD00066 13.92 7.000e−13 200−213 |
| 89 | PD02870 | RECEPTOR INTERLEUKIN-1 PRECURSOR. | PD02870D 15.74 8.468e−09 358−393 |
| 90 | BL00048 | Protamine P1 proteins. | BL00048 6.39 6.815e−13 64−91 BL00048 6.39 4.750e−11 56−83 BL00048 6.39 4.316e−10 55−82 BL00048 6.39 5.500e−10 70−97 BL00048 6.39 2.350e−09 62−89 BL00048 6.39 3.700e−09 60−87 BL00048 6.39 5.050e−09 63−90 BL00048 6.39 6.288e−09 61−88 BL00048 6.39 9.438e−09 71−98 |
| 91 | PR00320 | G-PROTEIN BETA WD-40 REPEAT SIGNATURE | PR00320C 13.01 8.920e−10 202−217<br>PR00320B 12.19 9.486e−10 202−217<br>PR00320C 13.01 7.900e−09 292−307<br>PR00320A 16.74 8.902e−09 202−217 |
| 92 | BL00453 | FKBP-type peptidyl-prolyl cis-trans isomerase proteins. | BL00453B 23.86 3.864e−28 106−140<br>BL00453A 15.57 1.000e−15 81−96<br>BL00453C 9.72 1.000e−12 147−160 |

TABLE 3-continued

| SEQ ID NO: | ACCESSION NO. | DESCRIPTION | RESULTS* |
|---|---|---|---|
| 94 | PR00299 | ALPHA CRYSTALLIN SIGNATURE | PR00299B 17.53 7.211e−09 324–337 |
| 95 | PF00676 | Dehydrogenase E1 component. | PF00676D 14.40 4.857e−13 421–441<br>PF00676C 16.88 1.931e−10 389–413<br>PF00676B 24.71 5.433e−10 192–230 |
| 98 | BL00824 | Elongation factor 1 beta/beta'/delta chain proteins. | BL00824B 9.21 3.919e−09 1472–1492 |
| 101 | PR00417 | PROKARYOTIC DNA TOPOISOMERASE I SIGNATURE | PR00417A 12.66 5.415e−09 866–880 |
| 104 | PD01066 | PROTEIN ZINC FINGER ZINC-FINGER METAL-BINDING NU. | PD01066 19.43 6.936e−29 17–56 |
| 105 | PD01066 | PROTEIN ZINC FINGER ZINC-FINGER METAL-BINDING NU. | PD01066 19.43 9.438e−37 10–49 |
| 106 | PD01781 | PROTEASE IMMUNOGLOBULIN PRECURSO. | PD01781B 27.55 8.680e−09 325–369 |
| 107 | PD01781 | PROTEASE IMMUNOGLOBULIN PRECURSO. | PD01781B 27.55 8.680e−09 379–423 |
| 109 | PR00939 | C2HC-TYPE ZINC-FINGER SIGNATURE | PR00939B 13.27 3.647e−09 1302–1311 |
| 110 | PD00066 | PROTEIN ZINC-FINGER METAL-BINDI. | PD00066 13.92 2.800e−14 279–292<br>PD00066 13.92 4.600e−14 307–320<br>PD00066 13.92 1.000e−13 335–348<br>PD00066 13.92 7.500e−13 363–376 |
| 111 | PR00193 | MYOSIN HEAVY CHAIN SIGNATURE | PR00193D 14.36 5.680e−33 391–420<br>PR00193C 12.60 4.789e−32 156–184<br>PR00193B 11.69 1.692e−26 110–136<br>PR00193E 19.47 5.500e−21 445–474<br>PR00193A 15.41 4.130e−20 54–74<br>PR00193E 19.47 5.091e−12 444–473 |
| 112 | BL00239 | Receptor tyrosine kinase class II proteins. | BL00239B 25.15 2.985e−16 67–115 |
| 113 | BL00678 | Trp-Asp (WD) repeat proteins proteins. | BL00678 9.67 2.800e−10 366–377<br>BL00678 9.67 5.263e−09 417–428<br>BL00678 9.67 6.211e−09 186–197 |
| 114 | DM00547 | 1 kw CHROMO BROMODOMAIN SHADOW GLOBAL. | DM00547F 23.43 2.350e−35 384–431<br>DM00547C 17.30 7.000e−19 23–45<br>DM00547E 13.94 5.592e−17 135–158<br>DM00547D 11.60 2.750e−13 105–119 |
| 116 | PR00700 | PROTEIN TYROSINE PHOSPHATASE SIGNATURE | PR00700D 12.47 8.788e−11 237–256 |
| 118 | PR00884 | RIBOSOMAL PROTEIN HS6 SIGNATURE | PR00884E 8.32 4.750e−09 449–466 |
| 119 | PD02890 | ISOMERASE CHALCONE-FLAVONONE FLAV. | PD02890C 16.14 8.457e−09 200–235 |
| 120 | BL00226 | Intermediate filaments proteins. | BL00226B 23.86 6.513e−10 401–449 |
| 121 | PD01823 | PROTEIN INTERGENIC REGION ABC1 PRECURSOR MITOCHONDRION T. | PD01823C 16.13 7.000e−14 352–373<br>PD01823B 14.96 3.782e−13 328–348<br>PD01823D 16.66 6.857e−10 430–451 |
| 124 | BL00854 | Proteasome B-type subunits proteins. | BL00854C 29.92 8.435e−19 114–143 |
| 126 | BL00651 | Ribosomal protein L9 proteins. | BL00651A 23.25 8.477e−17 94–134 |
| 127 | BL01245 | RIO1/ZK632.3/MJ0444 family proteins. | BL01245F 18.75 2.373e−23 334–371<br>BL01245A 14.04 8.342e−23 206–231<br>BL01245C 13.31 6.564e−15 262–282<br>BL01245E 15.28 1.000e−12 320–330<br>BL01245B 11.91 9.809e−10 245–255 |
| 130 | PR00793 | PROLYL AMINOPEPTIDASE (S33) FAMILY SIGNATURE | PR00793C 12.24 1.333e−09 168–183 |
| 131 | BL01160 | Kinesin light chain repeat proteins. | BL01160D 10.17 7.077e−09 505–534 |
| 132 | BL00355 | HMG14 and HMG17 proteins. | BL00355 5.97 8.412e−32 18–49 |
| 133 | PR00041 | CAMP RESPONSE | PR00041E 7.20 2.976e−13 305–326 |

TABLE 3-continued

| SEQ ID NO: | ACCESSION NO. | DESCRIPTION | RESULTS* |
|---|---|---|---|
| | | ELEMENT BINDING (CREB) PROTEIN SIGNATURE | |
| 134 | PR00211 | GLUTELIN SIGNATURE | PR00211B 0.86 1.750e−09 205−226 |
| | | | PR00211B 0.86 8.750e−09 199−220 |
| 135 | BL00455 | Putative AMP-binding domain proteins. | BL00455 13.31 5.125e−11 293−309 |
| 138 | PD00015 | GLYCOPROTEIN PRECURSOR CELL SI. | PD00015A 8.90 6.400e−09 243−251 |
| 140 | BL00227 | Tubulin subunits alpha, beta, and gamma proteins. | BL00227B 19.29 1.000e−40 52−107 |
| | | | BL00227C 25.48 1.000e−40 113−165 |
| | | | BL00227A 24.55 8.200e−36 1−35 |
| 142 | PR00049 | WILM'S TUMOR PROTEIN SIGNATURE | PR00049D 0.00 8.377e−13 60−75 |
| | | | PR00049D 0.00 7.500e−10 63−78 |
| | | | PR00049D 0.00 8.071e−10 61−76 |
| 143 | PR00049 | WILM'S TUMOR PROTEIN SIGNATURE | PR00049D 0.00 6.438e−12 1613−1628 |
| 144 | DM01970 | 0 kw ZK632.12 YDR313C ENDOSOMAL III. | DM01970B 8.60 4.750e−17 552−565 |
| 145 | PD00066 | PROTEIN ZINC-FINGER METAL-BINDI. | PD00066 13.92 5.846e−15 579−592 |
| | | | PD00066 13.92 9.217e−11 551−564 |
| | | | PD00066 13.92 6.700e−09 523−536 |
| 146 | PR00926 | MITOCHONDRIAL CARRIER PROTEIN SIGNATURE | PR00926F 17.75 3.672e−10 262−285 |
| 149 | DM01417 | 6 kw INDUCING XPMC2 MUSHROOM SPAC22G7.04. | DM01417C 12.93 3.250e−11 267−279 |
| | | | DM01417D 11.08 2.200e−10 306−322 |
| 150 | BL01160 | Kinesin light chain repeat proteins. | BL01160B 19.54 8.378e−10 349−403 |
| 153 | PR00049 | WILM'S TUMOR PROTEIN SIGNATURE | PR00049D 0.00 7.807e−11 419−434 |
| | | | PR00049D 0.00 8.563e−11 1284−1299 |
| | | | PR00049D 0.00 3.929e−10 1283−1298 |
| | | | PR00049D 0.00 3.288e−09 417−432 |
| 156 | BL00665 | Dihydrodipicolinate synthetase proteins. | BL00665D 14.76 1.000e−11 109−132 |
| | | | BL00665C 25.58 5.832e−11 50−101 |
| 158 | PD02906 | SYNTHASE I PSEUDOURIDYLATE PSEUDOURIDINE LYASE TR. | PD02906C 24.17 9.115e−15 171−206 |
| | | | PD02906B 15.35 4.886e−13 142−155 |
| | | | PD02906D 12.27 1.000e−09 239−249 |
| | | | PD02906A 10.84 8.333e−09 92−105 |
| 159 | BL00107 | Protein kinases ATP-binding region proteins. | BL00107B 13.31 2.286e−11 396−412 |
| | | | BL00107A 18.39 6.586e−11 332−363 |
| 162 | PF01008 | Initiation factor 2 subunit. | PF01008B 25.59 9.609e−36 366−409 |
| | | | PF01008A 20.14 8.676e−12 315−336 |
| | | | PF01008C 12.25 7.382e−10 449−469 |
| 163 | BL00591 | Glycosyl hydrolases family 10 proteins. | BL00591D 8.33 6.167e−09 2099−2112 |
| 165 | PR00019 | LEUCINE-RICH REPEAT SIGNATURE | PR00019B 11.36 7.120e−09 99−113 |
| | | | PR00019B 11.36 7.840e−09 73−87 |
| 166 | BL00636 | Nt-dnaJ domain proteins. | BL00636A 8.07 3.000e−14 143−160 |
| 167 | PR00310 | ANTI-PROLIFERATIVE PROTEIN BTG1 FAMILY SIGNATURE | PR00310B 10.59 4.000e−39 41−71 |
| | | | PR00310C 12.74 2.256e−33 71−101 |
| | | | PR00310D 9.10 9.820e−33 101−131 |
| | | | PR00310A 11.17 7.000e−27 16−41 |
| 168 | BL00216 | Sugar transport proteins. | BL00216B 27.64 2.688e−21 124−174 |
| 169 | BL00216 | Sugar transport proteins. | BL00216B 27.64 5.636e−20 124−174 |
| 170 | PD01066 | PROTEIN ZINC FINGER ZINC-FINGER METAL-BINDING NU. | PD01066 19.43 5.929e−32 59−98 |
| 172 | PR00456 | RIBOSOMAL PROTEIN P2 SIGNATURE | PR00456E 3.06 2.820e−11 6−21 |
| | | | PR00456E 3.06 7.563e−10 3−18 |
| 173 | PD00126 | PROTEIN REPEAT DOMAIN TPR NUCLEA. | PD00126A 22.53 4.706e−14 140−161 |
| | | | PD00126A 22.53 6.824e−14 289−310 |
| 175 | BL00741 | Guanine-nucleotide dissociation stimulators CDC24 family sign. | BL00741B 14.27 3.418e−11 294−317 |
| 177 | BL01016 | Glycoprotease family proteins. | BL01016C 22.84 5.292e−19 60−105 |
| | | | BL01016H 13.71 6.595e−12 307−317 |
| | | | BL01016E 14.88 3.182e−11 141−169 |
| | | | BL01016D 8.86 6.741e−09 118−131 |

TABLE 3-continued

| SEQ ID NO: | ACCESSION NO. | DESCRIPTION | RESULTS* |
|---|---|---|---|
| 178 | PR00850 | GLYCOSYL HYDROLASE FAMILY 59 SIGNATURE | PR00850B 6.67 5.455e−09 148−173 |
| 180 | PR00259 | TRANSMEMBRANE FOUR FAMILY SIGNATURE | PR00259A 9.27 8.676e−20 17−41<br>PR00259C 16.40 4.750e−17 85−114<br>PR00259B 14.81 8.615e−12 58−85<br>PR00259D 13.50 2.528e−11 235−262 |
| 181 | BL01052 | Calponin family repeat proteins. | BL01052C 18.51 6.806e−40 87−127<br>BL01052A 16.12 7.618e−32 3−35<br>BL01052B 15.31 8.031e−26 52−78<br>BL01052D 10.26 1.000e−24 174−194 |
| 182 | BL00875 | Bacterial type II secretion system protein D proteins. | BL00875A 25.57 6.447e−09 367−399 |
| 183 | PD01351 | PROTEIN REPEAT NEUROFILAMENT TRIPL. | PD01351B 13.72 5.355e−09 238−264 |
| 184 | DM01354 | kw TRANSCRIPTASE REVERSE II ORF2. | DM01354H 18.00 8.826e−27 109−149<br>DM01354G 11.57 2.143e−25 78−109<br>DM01354F 14.56 1.414e−15 42−78<br>DM01354E 18.69 8.650e−14 17−47 |
| 187 | BL00039 | DEAD-box subfamily ATP-dependent helicases proteins. | BL00039A 18.44 4.000e−25 222−261<br>BL00039D 21.67 4.529e−23 498−544<br>BL00039C 15.63 4.300e−16 347−371<br>BL00039B 19.19 9.379e−15 262−288 |
| 188 | PD00066 | PROTEIN ZINC-FINGER METAL-BINDI. | PD00066 13.92 5.714e−12 152−165<br>PD00066 13.92 6.143e−12 124−137 |
| 189 | BL01022 | PTR2 family proton/oligopeptide symporters proteins. | BL01022B 22.19 4.240e−10 308−354 |
| 192 | PR00830 | ENDOPEPTIDASE LA (LON) SERINE PROTEASE (S16) SIGNATURE | PR00830A 8.41 3.342e−09 881−901 |
| 193 | PR00109 | TYROSINE KINASE CATALYTIC DOMAIN SIGNATURE | PR00109B 12.27 9.234e−13 261−280 |
| 195 | BL01033 | Globins profile. | BL01033A 16.94 2.385e−18 25−47 |
| 197 | PR00320 | G-PROTEIN BETA WD-40 REPEAT SIGNATURE | PR00320B 12.19 6.226e−11 140−155<br>PR00320A 16.74 4.971e−10 140−155<br>PR00320C 13.01 9.280e−10 140−155 |
| 198 | PR00832 | PAXILLIN SIGNATURE | PR00832B 9.87 9.174e−10 309−333 |
| 199 | PR00674 | LIGHT HARVESTING PROTEIN B CHAIN SIGNATURE | PR00674A 20.10 7.391e−09 134−155 |
| 200 | PR00192 | F-ACTIN CAPPING PROTEIN BETA SUBUNIT SIGNATURE | PR00192C 6.65 2.500e−36 57−84<br>PR00192D 8.23 4.462e−36 97−125<br>PR00192E 8.85 7.000e−33 212−239<br>PR00192A 8.23 1.474e−27 5−26<br>PR00192B 6.20 3.000e−26 26−48 |
| 201 | PF00023 | Ank repeat proteins. | PF00023A 16.03 4.750e−10 45−61 |
| 203 | PR00239 | MOLLUSCAN RHODOPSIN C-TERMINAL TAIL SIGNATURE | PR00239E 1.58 6.114e−09 183−195 |
| 204 | BL00412 | Neuromodulin (GAP-43) proteins. | BL00412D 16.54 4.033e−10 319−370 |
| 205 | BL00790 | Receptor tyrosine kinase class V proteins. | BL00790R 16.20 7.677e−09 29−73 |
| 206 | BL00790 | Receptor tyrosine kinase class V proteins. | BL00790R 16.20 7.677e−09 29−73 |
| 207 | BL00790 | Receptor tyrosine kinase class V proteins. | BL00790R 16.20 7.677e−09 29−73 |
| 209 | BL00211 | ABC transporters family proteins. | BL00211B 13.37 3.077e−17 573−605<br>BL00211B 13.37 7.577e−17 1642−1674<br>BL00211A 12.23 1.900e−09 472−484 |
| 211 | PR00049 | WILM'S TUMOR PROTEIN SIGNATURE | PR00049D 0.00 1.786e−10 288−303 |
| 212 | BL00972 | Ubiquitin carboxyl-terminal hydrolases family 2 proteins. | BL00972D 22.55 3.348e−11 388−413<br>BL00972E 20.72 4.343e−09 415−437 |
| 216 | PD00469 | PROTEIN PRECURSOR SIGNAL HYDROLA. | PD00469A 13.95 6.400e−09 73−86 |
| 217 | PF00023 | Ank repeat proteins. | PF00023A 16.03 8.875e−10 839−855<br>PF00023A 16.03 2.286e−09 884−900 |
| 219 | BL00982 | Bacterial-type | BL00982A 18.41 8.013e−12 328−360 |

TABLE 3-continued

| SEQ ID NO: | ACCESSION NO. | DESCRIPTION | RESULTS* |
|---|---|---|---|
| | | phytoene dehydrogenase proteins. | |
| 220 | PF00595 | PDZ domain proteins (Also known as DHR or GLGF). | PF00595 13.40 4.600e−09 688−699 |
| 221 | BL00107 | Protein kinases ATP-binding region proteins. | BL00107A 18.39 7.000e−23 65−96<br>BL00107B 13.31 4.214e−10 130−146 |
| 222 | PR00239 | MOLLUSCAN RHODOPSIN C-TERMINAL TAIL SIGNATURE | PR00239E 1.58 3.045e−09 38−50 |
| 224 | BL00326 | Tropomyosins proteins. | BL00326A 14.01 5.337e−10 825−859 |
| 226 | BL00478 | LIM domain proteins. | BL00478B 14.79 8.527e−09 143−158 |
| 227 | DM00179 | w KINASE ALPHA ADHESION T-CELL. | DM00179 13.97 9.526e−10 135−145 |
| 228 | BL00048 | Protamine P1 proteins. | BL00048 6.39 6.063e−09 199−226 |
| 230 | BL00115 | Eukaryotic RNA polymerase II heptapeptide repeat proteins. | BL00115Z 3.12 5.744e−10 113−162<br>BL00115Z 3.12 3.449e−09 120−169 |
| 231 | BL01161 | Glucosamine/galactos amine-6-phosphate isomerases proteins. | BL01161A 19.47 1.000e−40 37−77<br>BL01161D 28.14 1.000e−40 199−244<br>BL01161B 21.37 5.091e−39 117−160<br>BL01161C 18.47 1.500e−23 170−199 |
| 233 | PR00269 | PLEIOTROPHIN/MIDKINE FAMILY SIGNATURE | PR00269A 13.91 3.571e−30 88−113 |
| 238 | BL00888 | Cyclic nucleotide-binding domain proteins. | BL00888B 14.79 9.069e−13 499−523 |
| 240 | BL01188 | GNS1/SUR4 family proteins. | BL01188B 13.46 4.115e−26 120−151<br>BL01188C 22.65 4.136e−26 151−202<br>BL01188D 8.62 1.290e−11 238−255<br>BL01188A 18.82 6.718e−10 55−87 |
| 241 | PR00929 | AT-HOOK-LIKE DOMAIN SIGNATURE | PR00929B 4.38 8.875e−09 571−583<br>PR00929C 5.26 8.914e−09 571−582 |
| 244 | BL00232 | Cadherins extracellular repeat proteins domain proteins. | BL00232B 32.79 2.765e−25 541−589<br>BL00232B 32.79 8.263e−22 766−814<br>BL00232B 32.79 2.397e−21 67−115<br>BL00232B 32.79 4.571e−19 1481−1529<br>BL00232B 32.79 1.000e−18 1371−1419<br>BL00232B 32.79 2.662e−18 1691−1739<br>BL00232B 32.79 5.292e−18 1287−1335<br>BL00232B 32.79 9.585e−18 1586−1634<br>BL00232B 32.79 1.265e−17 980−1028<br>BL00232B 32.79 1.529e−17 426−474<br>BL00232B 32.79 2.588e−17 1084−1132<br>BL00232B 32.79 1.386e−16 1184−1232<br>BL00232C 10.65 5.390e−12 1369−1387<br>BL00232C 10.65 1.391e−11 642−660<br>BL00232C 10.65 2.174e−11 1584−1602<br>BL00232C 10.65 4.522e−11 1689−1707<br>BL00232C 10.65 1.000e−10 65−83<br>BL00232C 10.65 4.115e−10 1285−1303<br>BL00232B 32.79 7.200e−10 649−697<br>BL00232C 10.65 9.827e−10 978−996<br>BL00232C 10.65 1.947e−09 170−188<br>BL00232B 32.79 2.137e−09 172−220<br>BL00232C 10.65 4.474e−09 1182−1200<br>BL00232C 10.65 8.737e−09 539−557 |
| 245 | BL00795 | Involucrin proteins. | BL00795C 17.06 4.977e−10 64−109<br>BL00795C 17.06 6.300e−09 55−100 |
| 246 | BL00790 | Receptor tyrosine kinase class V proteins. | BL00790I 20.01 7.823e−15 23−54<br>BL00790I 20.01 9.400e−11 310−341<br>BL00790I 20.01 1.900e−10 117−148<br>BL00790I 20.01 3.893e−09 215−246 |
| 247 | BL00183 | Ubiquitin-conjugating enzymes proteins. | BL00183 28.97 7.037e−10 140−188 |
| 248 | PR00019 | LEUCINE-RICH REPEAT SIGNATURE | PR00019A 11.19 8.800e−12 205−219<br>PR00019B 11.36 2.000e−11 202−216 |
| 249 | BL00214 | Cytosolic fatty-acid binding proteins. | BL00214B 26.51 7.618e−24 206−251<br>BL00214A 21.17 6.250e−22 165−191 |
| 250 | PR00395 | RIBOSOMAL PROTEIN S2 SIGNATURE | PR00395C 16.17 2.047e−13 46−64 |

TABLE 3-continued

| SEQ ID NO: | ACCESSION NO. | DESCRIPTION | RESULTS* |
|---|---|---|---|
| 251 | BL00227 | Tubulin subunits alpha, beta, and gamma proteins. | BL00227D 18.46 1.000e−40 74−128<br>BL00227F 21.16 1.529e−33 226−280<br>BL00227E 24.15 1.409e−26 178−213 |
| 252 | BL00227 | Tubulin subunits alpha, beta, and gamma proteins. | BL00227C 25.48 1.000e−40 39−91<br>BL00227D 18.46 1.000e−40 148−202<br>BL00227F 21.16 1.529e−33 300−354<br>BL00227E 24.15 1.409e−26 252−287 |
| 253 | BL00152 | ATP synthase alpha and beta subunits proteins. | BL00152B 21.40 1.900e−31 191−229<br>BL00152A 15.38 5.154e−21 134−160<br>BL00152C 11.41 6.250e−12 291−303 |
| 254 | BL00152 | ATP synthase alpha and beta subunits proteins. | BL00152E 22.68 1.000e−32 285−323<br>BL00152A 15.38 5.154e−21 134−160<br>BL00152C 11.41 6.250e−12 247−259 |
| 255 | BL00518 | Zinc finger, C3HC4 type (RING finger), proteins. | BL00518 12.23 2.200e−11 54−63 |
| 256 | DM00892 | 3 RETROVIRAL PROTEINASE. | DM00892C 23.55 9.739e−12 417−451 |
| 257 | BL01052 | Calponin family repeat proteins. | BL01052C 18.51 1.000e−40 88−128<br>BL01052A 16.12 2.875e−35 3−35<br>BL01052B 15.31 5.219e−26 52−78 |
| 258 | BL00745 | Prokaryotic-type class I peptide chain release factors signat. | BL00745C 13.66 1.000e−40 238−285<br>BL00745B 22.56 8.683e−33 184−227<br>BL00745D 14.90 8.435e−23 316−339<br>BL00745A 26.45 1.818e−19 123−162 |
| 259 | BL00745 | Prokaryotic-type class I peptide chain release factors signat. | BL00745C 13.66 1.000e−40 202−249<br>BL00745B 22.56 8.683e−33 148−191<br>BL00745D 14.90 8.435e−23 280−303 |
| 261 | BL00194 | Thioredoxin family proteins. | BL00194 12.16 7.429e−10 684−697 |
| 262 | BL00612 | Osteonectin domain proteins. | BL00612E 13.12 3.948e−10 391−436 |
| 264 | PR00625 | DNAJ PROTEIN FAMILY SIGNATURE | PR00625A 12.84 2.375e−09 288−308 |
| 265 | PR00320 | G-PROTEIN BETA WD-40 REPEAT SIGNATURE | PR00320B 12.19 2.125e−09 207−222 |
| 268 | BL01144 | Ribosomal protein L31e proteins. | BL01144 25.07 1.000e−40 21−73 |
| 270 | DM00516 | 186 DISCOIDIN I N-TERMINAL. | DM00516 30.53 8.606e−13 153−198 |
| 271 | BL00622 | Bacterial regulatory proteins, luxR family proteins. | BL00622 32.69 9.780e−09 11−58 |
| 272 | PR00048 | C2H2-TYPE ZINC FINGER SIGNATURE | PR00048A 10.52 1.000e−11 447−461<br>PR00048A 10.52 4.316e−11 389−403<br>PR00048A 10.52 6.684e−11 362−376 |
| 276 | DM00303 | 6 LEA 11-MER REPEAT REPEAT. | DM00303A 13.20 3.310e−09 467−517 |
| 277 | PF00622 | Domain in SPla and the RYanodine Receptor. | PF00622B 21.00 9.357e−14 374−396<br>PF00622C 12.62 1.857e−12 458−472 |
| 279 | PF00651 | BTB (also known as BR-C/Ttk) domain proteins. | PF00651 15.00 9.571e−10 65−78 |
| 280 | PD00066 | PROTEIN ZINC-FINGER METAL-BINDI. | PD00066 13.92 8.200e−16 295−308<br>PD00066 13.92 8.200e−16 519−532<br>PD00066 13.92 1.692e−15 351−364<br>PD00066 13.92 4.462e−15 547−560<br>PD00066 13.92 4.600e−14 323−336<br>PD00066 13.92 4.600e−14 435−448<br>PD00066 13.92 7.000e−14 463−476<br>PD00066 13.92 1.500e−13 239−252<br>PD00066 13.92 3.143e−12 267−280<br>PD00066 13.92 3.143e−12 407−420<br>PD00066 13.92 8.826e−11 211−224<br>PD00066 13.92 2.038e−10 491−504<br>PD00066 13.92 2.385e−10 379−392 |
| 281 | PD00066 | PROTEIN ZINC-FINGER METAL-BINDI. | PD00066 13.92 6.400e−16 449−462<br>PD00066 13.92 6.538e−15 504−517<br>PD00066 13.92 9.308e−15 421−434<br>PD00066 13.92 7.000e−14 476−489<br>PD00066 13.92 6.087e−11 393−406 |
| 282 | BL00291 | Prion protein. | BL00291A 4.49 5.229e−10 429−464 |
| 287 | BL00276 | Channel forming colicins proteins. | BL00276A 8.87 6.500e−09 257−269 |

TABLE 3-continued

| SEQ ID NO: | ACCESSION NO: | DESCRIPTION | RESULTS* |
|---|---|---|---|
| 288 | PD01066 | PROTEIN ZINC FINGER ZINC-FINGER METAL-BINDING NU. | PD01066 19.43 2.000e−30 10−49 |
| 289 | PD01066 | PROTEIN ZINC FINGER ZINC-FINGER METAL-BINDING NU. | PD01066 19.43 7.407e−23 3−42 |
| 291 | PR00070 | DIHYDROFOLATE REDUCTASE SIGNATURE | PR00070C 13.09 6.143e−16 51−63<br>PR00070D 11.63 2.929e−15 112−127 |
| 294 | PR00250 | FUNGAL PHEROMONE MATING FACTOR STE2 GPCR SIGNATURE | PR00250D 14.62 9.163e−09 254−278 |
| 296 | PR00081 | GLUCOSE/RIBITOL DEHYDROGENASE FAMILY SIGNATURE | PR00081A 10.53 2.731e−09 39−57 |
| 297 | PR00806 | VINCULIN SIGNATURE | PR00806B 4.28 8.920e−09 276−290<br>PR00806B 4.28 9.640e−09 275−289 |
| 298 | PF00992 | Troponin. | PF00992A 16.67 3.789e−10 553−588 |
| 300 | PR00511 | TEKTIN SIGNATURE | PR00511C 7.86 4.214e−09 371−388 |
| 302 | BL00353 | HMG1/2 proteins. | BL00353B 11.47 9.609e−19 228−278 |
| 303 | PR00240 | ALPHA-1A ADRENERGIC RECEPTOR SIGNATURE | PR00240C 8.38 3.941e−10 316−336 |
| 304 | BL00518 | Zinc finger, C3HC4 type (RING finger), proteins. | BL00518 12.23 2.200e−11 54−63 |
| 307 | PR00193 | MYOSIN HEAVY CHAIN SIGNATURE | PR00193D 14.36 1.545e−31 390−419<br>PR00193C 12.60 1.209e−25 143−171<br>PR00193B 11.69 2.543e−24 95−121<br>PR00193A 15.41 6.885e−19 39−59<br>PR00193E 19.47 3.291e−12 444−473 |
| 308 | PR00239 | MOLLUSCAN RHODOPSIN C-TERMINAL TAIL SIGNATURE | PR00239E 1.58 5.920e−11 47−59 |
| 309 | PD00015 | GLYCOPROTEIN PRECURSOR CELL SI. | PD00015A 8.90 6.400e−09 35−43 |
| 312 | DM00031 | IMMUNOGLOBULIN V REGION. | DM00031B 15.41 3.662e−11 80−114 |
| 313 | BL00824 | Elongation factor 1 beta/beta'/delta chain proteins. | BL00824C 14.58 1.000e−40 129−167<br>BL00824D 14.04 6.192e−39 167−202<br>BL00824B 9.21 2.080e−21 96−116<br>BL00824E 12.49 3.333e−19 210−226 |
| 314 | DM00099 | 4 kw A55R REDUCTASE TERMINAL DIHYDROPTERIDINE. | DM00099B 14.73 8.364e−11 525−535<br>DM00099B 14.73 9.438e−09 478−488 |
| 315 | PD01066 | PROTEIN ZINC FINGER ZINC-FINGER METAL-BINDING NU. | PD01066 19.43 6.200e−30 43−82 |
| 316 | PR00121 | SODIUM/POTASSIUM-TRANSPORTING ATPASE SIGNATURE | PR00121D 16.72 1.577e−13 210−232 |
| 317 | BL00888 | Cyclic nucleotide-binding domain proteins. | BL00888B 14.79 1.692e−10 396−420 |
| 318 | PR00727 | BACTERIAL LEADER PEPTIDASE 1 (S26) FAMILY SIGNATURE | PR00727C 13.04 9.063e−16 108−128<br>PR00727B 12.51 7.848e−11 81−94 |
| 319 | PD01066 | PROTEIN ZINC FINGER ZINC-FINGER METAL-BINDING NU. | PD01066 19.43 9.471e−27 13−52 |
| 321 | PR00004 | ANAPHYLATOXIN DOMAIN SIGNATURE | PR00004C 12.46 8.579e−09 91−103 |
| 322 | DM00060 | 338 kw NEUREXIN ALPHA III CYSTEINE. | DM00060 6.92 6.500e−11 28−38 |
| 327 | PR00020 | MAM DOMAIN SIGNATURE | PR00020A 18.17 5.776e−12 344−363<br>PR00020C 13.66 6.932e−10 417−429 |
| 328 | BL00048 | Protamine P1 proteins. | BL00048 6.39 6.566e−10 167−194 |
| 329 | PR00020 | MAM DOMAIN SIGNATURE | PR00020C 13.66 2.615e−11 581−593<br>PR00020B 15.52 5.059e−10 52−69<br>PR00020B 15.52 1.789e−09 553−570 |
| 331 | PD01066 | PROTEIN ZINC FINGER ZINC-FINGER METAL-BINDING NU. | PD01066 19.43 9.357e−32 8−47 |
| 334 | PD02870 | RECEPTOR INTERLEUKIN-1 PRECURSOR. | PD02870B 18.83 5.871e−11 468−501 |

TABLE 3-continued

| SEQ ID NO: | ACCESSION NO. | DESCRIPTION | RESULTS* |
|---|---|---|---|
| 335 | BL00738 | S-adenosyl-L-homocysteine hydrolase proteins. | BL00738J 18.61 1.000e−40 592−642<br>BL00738H 23.08 5.320e−36 468−521<br>BL00738F 12.23 7.261e−29 387−419<br>BL00738A 16.27 9.660e−27 216−256<br>BL00738C 16.53 7.923e−25 281−319<br>BL00738G 14.29 6.268e−23 446−468<br>BL00738B 12.28 8.085e−21 256−281<br>BL00738E 14.18 9.200e−19 361−384<br>BL00738I 14.57 5.135e−17 545−583<br>BL00738D 7.16 5.109e−13 335−350 |
| 339 | PR00425 | BRADYKININ RECEPTOR SIGNATURE | PR00425C 13.23 3.586e−09 80−100 |
| 344 | PD01823 | PROTEIN INTERGENIC REGION ABC1 PRECURSOR MITOCHONDRION T. | PD01823E 9.30 6.824e−12 108−121<br>PD01823D 16.66 1.265e−09 46−67 |
| 345 | PR00976 | RIBOSOMAL PROTEIN S21 FAMILY SIGNATURE. | PR00976C 10.41 2.837e−09 396−407 |
| 346 | PR00613 | MYOGLOBIN SIGNATURE | PR00613B 9.02 2.581e−10 25−49 |
| 347 | PR00814 | BETA HAEMOGLOBIN SIGNATURE | PR00814C 9.20 6.523e−10 104−122 |
| 350 | BL00038 | Myc-type, 'helix-loop-helix' dimerization domain proteins. | BL00038B 16.97 7.568e−10 117−138 |
| 351 | PD01066 | PROTEIN ZINC FINGER ZINC-FINGER METAL-BINDING NU. | PD01066 19.43 6.571e−32 6−45 |
| 352 | BL00972 | Ubiquitin carboxyl-terminal hydrolases family 2 proteins. | BL00972A 11.93 6.318e−19 364−382<br>BL00972D 22.55 7.968e−16 648−673<br>BL00972B 9.45 1.600e−12 445−455 |
| 354 | BL00518 | Zinc finger, C3HC4 type (RING finger), proteins. | BL00518 12.23 4.429e−10 214−223 |
| 355 | BL00518 | Zinc finger, C3HC4 type (RING finger), proteins. | BL00518 12.23 4.429e−10 179−188 |
| 356 | BL01009 | Extracellular proteins SCP/Tpx-1/Ag5/PR-1/Sc7 proteins. | BL01009D 14.19 9.341e−17 160−181<br>BL01009A 13.75 3.769e−14 80−98<br>BL01009E 13.50 5.333e−14 194−210<br>BL01009C 10.54 2.667e−11 127−141 |
| 358 | BL00215 | Mitochondrial energy transfer proteins. | BL00215A 15.82 8.500e−17 16−41<br>BL00215B 10.44 4.900e−09 177−190<br>BL00215A 15.82 6.786e−09 133−158<br>BL00215B 10.44 7.300e−09 278−291 |
| 359 | BL00053 | Ribosomal protein S8 proteins. | BL00053C 16.71 5.500e−26 107−140<br>BL00053B 14.56 4.789e−14 67−85<br>BL00053A 8.83 5.320e−12 14−27 |
| 360 | PR00326 | GTP1/OBG GTP-BINDING PROTEIN FAMILY SIGNATURE | PR00326A 8.75 7.150e−11 21−42 |
| 361 | BL00972 | Ubiquitin carboxyl-terminal hydrolases family 2 proteins. | BL00972A 11.93 6.318e−19 324−342<br>BL00972D 22.55 3.903e−16 608−633<br>BL00972B 9.45 1.600e−12 405−415 |
| 364 | PR00759 | BASIC PROTEASE (KUNITZ-TYPE) INHIBITOR FAMILY SIGNATURE | PR00759C 14.15 7.750e−10 123−139 |
| 367 | DM00215 | PROLINE-RICH PROTEIN 3. | DM00215 19.43 1.482e−10 355−388 |
| 368 | BL00518 | Zinc finger, C3HC4 type (RING finger), proteins. | BL00518 12.23 2.800e−11 125−134 |
| 370 | PD00126 | PROTEIN REPEAT DOMAIN TPR NUCLEA. | PD00126A 22.53 8.448e−09 2−23 |
| 373 | BL00028 | Zinc finger, C2H2 type, domain proteins. | BL00028 16.07 7.353e−14 157−174<br>BL00028 16.07 1.000e−13 269−286<br>BL00028 16.07 8.200e−13 493−510<br>BL00028 16.07 3.739e−12 213−230<br>BL00028 16.07 6.478e−12 381−398<br>BL00028 16.07 1.346e−11 185−202<br>BL00028 16.07 2.385e−11 129−146<br>BL00028 16.07 2.385e−11 325−342<br>BL00028 16.07 5.154e−11 241−258<br>BL00028 16.07 9.654e−11 437−454<br>BL00028 16.07 1.300e−10 297−314 |

TABLE 3-continued

| SEQ ID NO: | ACCESSION NO. | DESCRIPTION | RESULTS* |
|---|---|---|---|
| | | | BL00028 16.07 9.100e−10 409−426 |
| | | | BL00028 16.07 9.100e−10 465−482 |
| 374 | BL01020 | SAR1 family proteins. | BL01020C 15.35 8.063e−20 79−130 |
| 376 | BL00028 | Zinc finger, C2H2 type, domain proteins. | BL00028 16.07 4.522e−12 208−225 |
| 377 | PR00308 | TYPE I ANTIFREEZE PROTEIN SIGNATURE | PR00308A 5.90 7.288e−11 533−548
PR00308A 5.90 8.835e−09 534−549 |
| 380 | PD02784 | PROTEIN NUCLEAR RIBONUCLEOPROTEIN. | PD02784B 26.46 7.538e−09 147−190 |
| 381 | PD01351 | PROTEIN REPEAT NEUROFILAMENT TRIPL. | PD01351A 8.69 7.469e−09 155−166 |
| 383 | PF00094 | von Willebrand factor type D domain proteins. | PF00094C 12.88 1.918e−09 43−53 |
| 384 | BL01105 | Ribosomal protein L35Ae proteins. | BL01105B 12.95 7.930e−13 43−83 |
| 387 | PR00049 | WILM'S TUMOR PROTEIN SIGNATURE | PR00049D 0.00 9.643e−10 10−25
PR00049D 0.00 1.915e−09 9−24 |
| 388 | BL01115 | GTP-binding nuclear protein ran proteins. | BL01115A 10.22 8.909e−13 34−78 |
| 389 | BL00115 | Eukaryotic RNA polymerase II heptapeptide repeat proteins. | BL00115Z 3.12 7.977e−10 397−446 |
| 390 | PR00021 | SMALL PROLINE-RICH PROTEIN SIGNATURE | PR00021A 4.31 2.125e−19 4−17
PR00021D 6.09 3.323e−13 21−30
PR00021D 6.09 3.323e−13 30−39
PR00021E 6.82 7.545e−13 57−67
PR00021B 7.29 9.333e−13 18−28
PR00021B 7.29 3.302e−12 27−37
PR00021C 5.55 1.225e−10 21−28
PR00021C 5.55 1.225e−10 30−37
PR00021D 6.09 2.770e−09 39−48 |
| 391 | PF00646 | F-box domain proteins. | PF00646A 14.37 9.036e−10 28−42 |
| 392 | BL00036 | bZIP transcription factors basic domain proteins. | BL00036 9.02 6.294e−12 81−94 |
| 393 | PF00622 | Domain in SPla and the RYanodine Receptor. | PF00622B 21.00 2.500e−13 85−107 |
| 394 | BL00564 | Argininosuccinate synthase proteins. | BL00564A 19.93 6.114e−09 7−44 |
| 395 | PR00048 | C2H2-TYPE ZINC FINGER SIGNATURE | PR00048A 10.52 7.750e−14 230−244
PR00048A 10.52 4.316e−11 202−216 |
| 396 | PF00622 | Domain in SPla and the RYanodine Receptor. | PF00622B 21.00 1.391e−16 132−154 |
| 397 | PR00501 | KELCH REPEAT SIGNATURE | PR00501A 8.25 1.409e−09 537−551 |
| 398 | PR00399 | SYNAPTOTAGMIN SIGNATURE | PR00399A 9.52 3.571e−19 146−162
PR00399C 12.82 8.200e−17 222−238
PR00399B 14.27 7.750e−16 161−175
PR00399D 14.48 4.000e−14 242−253 |
| 399 | BL01013 | Oxysterol-binding protein family proteins. | BL01013A 25.14 7.231e−21 558−594
BL01013B 11.33 1.000e−11 623−634 |
| 400 | PF00023 | Ank repeat proteins. | PF00023A 16.03 1.750e−10 55−71 |
| 401 | BL00422 | Granins proteins. | BL00422C 16.18 5.787e−10 134−162 |
| 402 | PR00029 | OCTAMER-BINDING TRANSCRIPTION FACTOR SIGNATURE | PR00029C 6.10 5.708e−09 140−153 |
| 403 | PR00450 | RECOVERIN FAMILY SIGNATURE | PR00450D 16.58 8.986e−11 161−181 |
| 404 | PR00049 | WILM'S TUMOR PROTEIN SIGNATURE | PR00049D 0.00 7.407e−09 325−340 |
| 405 | DM01117 | 2 kw TRANSPOSASE WITHIN TRANSPOSITION VASOTOCIN. | DM01117A 11.17 7.750e−09 364−382 |
| 406 | DM01206 | CORONAVIRUS NUCLEOCAPSID PROTEIN. | DM01206B 10.69 9.286e−12 724−744
DM01206B 10.69 3.466e−10 726−746
DM01206B 10.69 9.630e−10 722−742
DM01206B 10.69 7.152e−09 718−738
DM01206B 10.69 8.861e−09 728−748 |

TABLE 3-continued

| SEQ ID NO: | ACCESSION NO. | DESCRIPTION | RESULTS* |
|---|---|---|---|
| 407 | PD01066 | PROTEIN ZINC FINGER ZINC-FINGER METAL-BINDING NU. | PD01066 19.43 1.353e−27 31−70 |
| 408 | PR00169 | POTASSIUM CHANNEL SIGNATURE | PR00169A 16.77 1.711e−09 94−114 |
| 409 | BL00610 | Sodium: neurotransmitter symporter family proteins. | BL00610A 17.73 1.000e−40 68−118<br>BL00610B 23.65 1.000e−40 132−182<br>BL00610C 12.94 1.000e−40 225−277<br>BL00610D 20.97 1.000e−40 291−344<br>BL00610F 29.02 6.143e−36 540−595<br>BL00610E 20.34 3.647e−35 448−491<br>BL00610G 12.89 2.200e−15 611−634 |
| 410 | DM00179 | w KINASE ALPHA ADHESION T-CELL. | DM00179 13.97 5.304e−09 111−121 |
| 411 | PR00625 | DNAJ PROTEIN FAMILY SIGNATURE | PR00625B 13.48 1.800e−16 45−66<br>PR00625A 12.84 6.700e−12 15−35 |
| 412 | PR00927 | ADENINE NUCLEOTIDE TRANSLOCATOR 1 SIGNATURE | PR00927E 14.93 4.136e−11 246−268 |
| 413 | PD00066 | PROTEIN ZINC-FINGER METAL-BINDI. | PD00066 13.92 6.400e−17 411−424<br>PD00066 13.92 8.200e−17 327−340<br>PD00066 13.92 5.154e−15 271−284<br>PD00066 13.92 2.800e−14 215−228<br>PD00066 13.92 9.000e−13 355−368<br>PD00066 13.92 6.143e−12 439−452<br>PD00066 13.92 6.478e−11 187−200<br>PD00066 13.92 9.217e−11 243−256 |
| 414 | BL00303 | S-100/ICaBP type calcium binding protein. | BL00303B 26.15 2.552e−23 51−88<br>BL00303A 21.77 5.846e−20 4−41 |
| 416 | PR00014 | FIBRONECTIN TYPE III REPEAT SIGNATURE | PR00014C 15.44 4.600e−10 73−92 |
| 417 | PR00806 | VINCULIN SIGNATURE | PR00806A 6.63 1.493e−09 785−796 |
| 418 | PF00622 | Domain in SPla and the RYanodine Receptor. | PF00622B 21.00 1.000e−13 331−353<br>PF00622C 12.62 3.160e−11 415−429 |
| 419 | PF00780 | Domain found in NIK1-like kinases, mouse citron and yeast ROM. | PF00780B 23.03 5.929e−33 442−485 |
| 420 | BL01253 | Type I fibronectin domain proteins. | BL01253H 13.15 8.452e−13 203−238<br>BL01253D 4.84 2.016e−12 41−55 |
| 421 | BL01207 | Glypicans proteins. | BL01207B 23.69 9.122e−28 191−237<br>BL01207A 12.21 1.000e−16 62−78 |
| 426 | PD02870 | RECEPTOR INTERLEUKIN-1 PRECURSOR. | PD02870D 15.74 4.351e−09 693−728 |
| 427 | BL00203 | Vertebrate metallothioneins proteins. | BL00203 13.94 5.041e−09 13−59 |
| 428 | BL00107 | Protein kinases ATP-binding region proteins. | BL00107A 18.39 8.579e−18 217−248 |
| 431 | PR00141 | PROTEASOME COMPONENT SIGNATURE | PR00141C 11.15 6.333e−12 234−246<br>PR00141D 12.45 8.615e−12 259−271<br>PR00141B 11.15 9.561e−12 223−235<br>PR00141A 11.36 2.050e−11 102−118 |
| 432 | PR00245 | OLFACTORY RECEPTOR SIGNATURE | PR00245A 18.03 9.413e−17 59−81<br>PR00245C 7.84 7.500e−16 238−254<br>PR00245E 12.40 2.500e−12 291−306<br>PR00245B 10.38 9.550e−11 177−192 |
| 433 | PF00651 | BTB (also known as BR-C/Ttk) domain proteins. | PF00651 15.00 1.000e−11 87−100 |
| 436 | BL00086 | Cytochrome P450 cysteine heme-iron ligand proteins. | BL00086 20.87 3.647e−23 430−462 |
| 437 | BL00216 | Sugar transport proteins. | BL00216B 27.64 7.943e−19 101−151 |
| 438 | PR00049 | WILM'S TUMOR PROTEIN SIGNATURE | PR00049D 0.00 8.429e−10 10−25 |
| 439 | PR00245 | OLFACTORY RECEPTOR SIGNATURE | PR00245A 18.03 2.667e−23 100−122<br>PR00245C 7.84 1.783e−14 232−248<br>PR00245D 10.47 7.070e−10 268−280 |
| 440 | PR00262 | IL1/HBGF FAMILY SIGNATURE | PR00262A 28.26 1.000e−08 80−108 |

TABLE 3-continued

| SEQ ID NO: | ACCESSION NO. | DESCRIPTION | RESULTS* |
|---|---|---|---|
| 441 | BL00884 | Osteopontin proteins. | BL00884B 12.47 1.000e−40 50−94<br>BL00884C 22.45 6.625e−39 131−173<br>BL00884A 11.35 5.846e−32 1−31<br>BL00884E 11.04 8.364e−23 273−295<br>BL00884D 8.79 3.323e−18 255−272 |

*Results include in order: accession number subtype; raw score; p-value; postion of signature in amino acid sequence.

TABLE 4

| SEQ ID NO: | pFAM NAME | DESCRIPTION | p-value | pFAM SCORE |
|---|---|---|---|---|
| 1 | zf-CCCH | Zinc finger C-x8-C-x5-C-x3-H type (and similar). | 2.5e−09 | 38.4 |
| 3 | ArfGap | Putative GTP-ase activating protein for Arf | 1.3e−52 | 188.3 |
| 4 | EMP24_GP25L | emp24/gp25L/p24 family | 4.1e−105 | 362.6 |
| 7 | WW | WW domain | 1.2e−05 | 32.2 |
| 8 | WW | WW domain | 1.2e−05 | 32.2 |
| 9 | Aa_trans | Transmembrane amino acid transporter protein | 9.6e−64 | 225.2 |
| 10 | Fe-ADH | Iron-containing alcohol dehydrogenases | 9.9e−35 | 124.5 |
| 11 | Fe-ADH | Iron-containing alcohol dehydrogenases | 9.9e−35 | 124.5 |
| 12 | Bcl-2 | Apoptosis regulator proteins, Bcl-2 family | 0.016 | −2.1 |
| 13 | spectrin | Spectrin repeat | 1.3e−10 | 43.6 |
| 14 | Ribosomal_L18ae | Ribosomal L18ae protein family | 1.9e−128 | 440.1 |
| 15 | Ribosomal_L31e | Ribosomal protein L31e | 2.4e−47 | 170.7 |
| 17 | zf-MYND | MYND finger | 1.4e−13 | 58.5 |
| 19 | MgtE | Divalent cation transporter | 8.6e−39 | 142.3 |
| 20 | Rap_GAP | Rap/ran-GAP | 2e−124 | 426.7 |
| 21 | Rap_GAP | Rap/ran-GAP | 2e−124 | 426.7 |
| 23 | SCAN | SCAN domain | 1.3e−24 | 95.2 |
| 24 | RhoGAP | RhoGAP domain | 3e−58 | 206.9 |
| 25 | adh_zinc | Zinc-binding dehydrogenases | 1.5e−05 | −25.4 |
| 26 | UDPGT | UDP-glucoronosyl and UDP-glucosyl transferases | 1.6e−84 | 294.3 |
| 27 | MCT | Monocarboxylate transporter | 3.3e−49 | 176.9 |
| 29 | Ribosomal_L6e | Ribosomal_protein L6e | 9.5e−78 | 271.7 |
| 30 | Ribosomal_L11 | Ribosomal protein L11 | 4.9e−64 | 226.2 |
| 31 | tRNA-synt_1e | tRNA synthetases class I (C) | 1.6e−137 | 470.2 |
| 33 | zf-C3HC4 | Zinc finger, C3HC4 type (RING finger) | 0.00041 | 17.6 |
| 35 | SH3 | SH3 domain | 8.7e−32 | 119.0 |
| 36 | ras | Ras family | 2.6e−78 | 273.6 |
| 38 | SET | SET domain | 3.2e−05 | 10.0 |
| 39 | laminin_G | Laminin G domain | 1.5e−11 | 44.7 |
| 40 | Sema | Sema domain | 5e−127 | 435.4 |
| 42 | filament | Intermediate filament proteins | 1.6e−138 | 473.6 |
| 43 | Keratin_B2 | Keratin, high sulfur B2 protein | 1.8e−18 | 74.8 |
| 46 | sushi | Sushi domain (SCR repeat) | 3.8e−06 | 33.9 |
| 47 | profilin | Profilins | 4.1e−13 | 51.7 |
| 49 | ubiquitin | Ubiquitin family | 0.069 | 10.3 |
| 50 | BTB | BTB/POZ domain | 2.6e−21 | 84.2 |
| 51 | serpin | Serpins (serine protease inhibitors) | 2.4e−178 | 605.4 |
| 52 | T-box | T-box | 3.6e−125 | 429.2 |
| 54 | 7tm_1 | 7 transmembrane receptor (rhodopsin family) | 1.2e−17 | 58.3 |
| 55 | CSD | 'Cold-shock' DNA-binding domain | 1.8e−16 | 63.6 |

TABLE 4-continued

| SEQ ID NO: | pFAM NAME | DESCRIPTION | p-value | pFAM SCORE |
|---|---|---|---|---|
| 56 | ig | Immunoglobulin domain | 2.5e−07 | 28.7 |
| 57 | Rap_GAP | Rap/ran-GAP | 5e−18 | 73.3 |
| 59 | G-gamma | GGL domain | 1.1e−11 | 45.4 |
| 60 | T-box | T-box | 8.9e−114 | 391.4 |
| 63 | 60s_ribosomal | 60s Acidic ribosomal protein | 0.0089 | 12.0 |
| 64 | UPAR_LY6 | u-PAR/Ly-6 domain | 5.4e−05 | 22.3 |
| 65 | Ribosomal_L30 | Ribosomal protein L30p/L7e | 0.00042 | 18.5 |
| 66 | filament | Intermediate filament proteins | 1.1e−78 | 274.8 |
| 67 | Ribosomal_S6 | Ribosomal protein S6 | 0.00082 | 7.5 |
| 68 | PDZ | PDZ domain (Also known as DHR or GLGF). | 5.1e−09 | 43.4 |
| 69 | zf-C3HC4 | Zinc finger, C3HC4 type (RING finger) | 0.005 | 14.0 |
| 70 | G-patch | G-patch domain | 0.00051 | 26.8 |
| 71 | Keratin_B2 | Keratin, high sulfur B2 protein | 0.037 | −45.9 |
| 85 | ig | Immunoglobulin domain | 8.5e−09 | 33.4 |
| 88 | zf-C2H2 | Zinc finger, C2H2 type | 7.1e−71 | 248.9 |
| 89 | ig | Immunoglobulin domain | 2.7e−35 | 118.7 |
| 91 | WD40 | WD domain, G-beta repeat | 7.5e−10 | 46.2 |
| 92 | FKBP | FKBP-type peptidyl-prolyl cis-trans isomerases | 1.3e−53 | 173.3 |
| 95 | E1_dehydrog | Dehydrogenase E1 component | 8.7e−23 | 89.1 |
| 97 | zf-C3HC4 | Zinc finger, C3HC4 type (RING finger) | 8.7e−09 | 32.7 |
| 99 | ig | Immunoglobulin domain | 1.8e−20 | 71.0 |
| 100 | ig | Immunoglobulin domain | 1.8e−20 | 71.0 |
| 104 | zf-C2H2 | Zinc finger, C2H2 type | 2.4e−94 | 326.8 |
| 105 | zf-C2H2 | Zinc finger, C2H2 type | 1.6e−55 | 197.9 |
| 109 | zf-CCHC | Zinc finger, CCHC class | 2.6e−12 | 54.4 |
| 110 | zf-C2H2 | Zinc finger, C2H2 type | 2.2e−42 | 154.3 |
| 111 | myosin_head | Myosin head (motor domain) | 0 | 1267.5 |
| 112 | pkinase | Eukaryotic protein kinase domain | 1.2e−96 | 334.5 |
| 113 | WD40 | WD domain, G-beta repeat | 5.9e−65 | 229.2 |
| 114 | SNF2_N | SNF2 and others N-terminal domain | 4.2e−78 | 272.9 |
| 115 | DUF15 | Domain of unknown function DUF15 | 0.0011 | −65.2 |
| 116 | DSPc | Dual specificity phosphatase, catalytic domain | 0.00056 | 3.7 |
| 119 | Rhodanese | Rhodanese-like domain | 1e−05 | 32.5 |
| 124 | proteasome | Proteasome A-type and B-type | 7.4e−43 | 155.8 |
| 126 | Ribosomal_L9 | Ribosomal protein L9 | 3.1e−05 | −3.4 |
| 127 | RIO1 | RIO1/ZK632.3/MJ0444 family | 7.8e−80 | 278.6 |
| 130 | abhydrolase | alpha/beta hydrolase fold | 9e−20 | 79.1 |
| 131 | TPR | TPR Domain | 5.7e−27 | 103.0 |
| 132 | HMG14_17 | HMG14 and HMG17 | 1.9e−15 | 64.7 |
| 133 | bZIP | bZIP transcription factor | 8.3e−19 | 71.7 |
| 134 | rrm | RNA recognition motif. (a.k.a. RRM, RBD, or RNP domain) | 1.9e−31 | 117.9 |
| 135 | AMP-binding | AMP-binding enzyme | 6.3e−98 | 338.7 |
| 140 | tubulin | Tubulin/FtsZ family | 2.1e−151 | 516.4 |
| 143 | laminin_EGF | Laminin EGF-like (Domains III and V) | 7.6e−12 | 52.8 |
| 144 | FYVE | FYVE zinc finger | 2.3e−29 | 109.1 |
| 145 | zf-C2H2 | Zinc finger, C2H2 type | 2.4e−33 | 124.2 |
| 146 | mito_carr | Mitochondrial carrier proteins | 3e−54 | 188.9 |
| 148 | DAGKc | Diacylglycerol kinase catalytic domain (presumed) | 0.00015 | 26.0 |
| 149 | Exonuclease | Exonuclease | 2.1e−17 | 71.3 |
| 152 | GTP_EFTU | Elongation factor Tu family | 8.5e−09 | 32.3 |
| 153 | WH2 | Wiskott Aldrich syndrome homology region 2 | 6.5e−20 | 79.6 |

TABLE 4-continued

| SEQ ID NO: | pFAM NAME | DESCRIPTION | p-value | pFAM SCORE |
|---|---|---|---|---|
| 154 | SAM | SAM domain (Sterile alpha motif) | 0.032 | 11.4 |
| 156 | DHDPS | Dihydrodipicolinate synthetase family | 1.3e−26 | 101.9 |
| 158 | PseudoU_synth_1 | tRNA pseudouridine synthase | 1e−30 | 115.4 |
| 159 | pkinase | Eukaryotic protein kinase domain | 2.3e−59 | 210.6 |
| 162 | IF-2B | Initiation factor 2 subunit family | 1.7e−98 | 340.7 |
| 163 | Beach | Beige/BEACH domain | 1.1e−224 | 759.8 |
| 166 | DnaJ | DnaJ domain | 8.1e−11 | 49.4 |
| 167 | Anti_proliferat | BTG1 family | 7.4e−85 | 295.3 |
| 168 | sugar_tr | Sugar (and other) transporter | 3.1e−80 | 280.0 |
| 169 | sugar_tr | Sugar (and other) transporter | 2.9e−52 | 187.0 |
| 170 | zf-C2H2 | Zinc finger, C2H2 type | 2.2e−93 | 323.6 |
| 171 | GBP | Guanylate-binding protein | 4.3e−255 | 860.8 |
| 173 | TPR | TPR Domain | 1.1e−42 | 155.2 |
| 175 | RhoGEF | RhoGEF domain | 3.3e−40 | 147.0 |
| 176 | zf-C3HC4 | Zinc finger, C3HC4 type (RING finger) | 0.00011 | 19.4 |
| 177 | Peptidase_M22 | Glycoprotease family | 2.3e−73 | 257.2 |
| 179 | TBC | TBC domain | 4.7e−08 | 10.1 |
| 180 | transmembrane4 | Transmembrane 4 family | 1.9e−49 | 161.1 |
| 181 | CH | Calponin homology (CH) domain | 1.2e−25 | 98.6 |
| 184 | AP_endonucleas1 | AP endonuclease family 1 | 0.088 | −90.2 |
| 186 | Bacterial_PQQ | PQQ enzyme repeat | 9.3e−05 | 29.2 |
| 187 | DEAD | DEAD/DEAH box helicase | 1.6e−60 | 194.3 |
| 188 | zf-C2H2 | Zinc finger, C2H2 type | 4.2e−24 | 93.5 |
| 189 | sugar_tr | Sugar (and other) transporter | 0.0011 | −88.8 |
| 190 | tRNA_int_endo | tRNA intron endonuclease | 0.0012 | −32.1 |
| 191 | WSC | WSC domain | 1e−35 | 132.1 |
| 193 | pkinase | Eukaryotic protein kinase domain | 5.1e−75 | 262.6 |
| 195 | globin | Globin | 1.9e−26 | 96.6 |
| 197 | WD40 | WD domain, G-beta repeat | 1.8e−07 | 38.2 |
| 200 | F_actin_cap_B | F-actin capping protein, beta subunit | 1.7e−224 | 759.2 |
| 201 | ank | Ank repeat | 3.1e−59 | 210.2 |
| 205 | PDZ | PDZ domain (Also known as DHR or GLGF). | 4.2e−07 | 37.0 |
| 206 | SAM | SAM domain (Sterile alpha motif) | 2.2e−05 | 31.3 |
| 207 | SAM | SAM domain (Sterile alpha motif) | 2.2e−05 | 31.3 |
| 208 | zf-UBR1 | Putative zinc finger in N-recognin | 3.9e−26 | 100.3 |
| 209 | ABC_tran | ABC transporter | 2.4e−112 | 386.6 |
| 211 | zf-C2H2 | Zinc finger, C2H2 type | 0.00031 | 27.5 |
| 212 | UCH-2 | Ubiquitin carboxyl-terminal hydrolase family 2 | 1.5e−19 | 78.4 |
| 213 | IMP4 | Domain of unknown function | 2.2e−33 | 124.3 |
| 215 | zf-C2H2 | Zinc finger, C2H2 type | 3.5e−08 | 40.6 |
| 216 | PG_binding_2 | Putative peptidoglycan binding domain | 2.1e−11 | 51.3 |
| 219 | pyr_redox | Pyridine nucleotide-disulphide oxidoreductase | 1.2e−70 | 241.7 |
| 220 | PDZ | PDZ domain (Also known as DHR or GLGF). | 8.5e−19 | 75.9 |
| 221 | pkinase | Eukaryotic protein kinase domain | 8.1e−67 | 235.4 |
| 222 | dsrm | Double-stranded RNA binding motif | 0.095 | 7.5 |
| 223 | PHD | PHD-finger | 4.7e−05 | 29.9 |
| 225 | TRM | N2, N2-dimethylguanosine tRNA methyltransferase | 7.3e−22 | 86.1 |
| 226 | LIM | LIM domain containing proteins | 8.6e−08 | 32.7 |
| 227 | ig | Immunoglobulin domain | 1.1e−07 | 29.8 |
| 229 | F-box | F-box domain. | 2.2e−07 | 38.0 |
| 231 | Glucosamine_iso | Glucosamine-6-phosphate isomerase | 1.8e−146 | 500.0 |

TABLE 4-continued

| SEQ ID NO: | pFAM NAME | DESCRIPTION | p-value | pFAM SCORE |
|---|---|---|---|---|
| 233 | PTN_MK | PTN/MK heparin-binding protein family | 1.9e−44 | 161.1 |
| 238 | CNG_membrane | Transmembrane region cyclic Nucleotide Gated Channel | 5.8e−31 | 116.3 |
| 240 | GNS1_SUR4 | GNS1/SUR4 family | 4.1e−46 | 166.6 |
| 243 | PIP5K | Phosphatidylinositol-4-phosphate 5-Kinase | 6.2e−142 | 484.9 |
| 244 | cadherin | Cadherin domain | 0 | 1298.9 |
| 246 | fn3 | Fibronectin type III domain | 1.2e−31 | 118.6 |
| 247 | UQ_con | Ubiquitin-conjugating enzyme | 1.4e−16 | 68.5 |
| 248 | LRR | Leucine Rich Repeat | 3.4e−14 | 60.6 |
| 249 | lipocalin | Lipocalin / cytosolic fatty-acid binding protein family | 1.2e−28 | 102.8 |
| 250 | Ribosomal_S2 | Ribosomal protein S2 | 2.9e−11 | 43.7 |
| 251 | tubulin | Tubulin/FtsZ family | 8.5e−163 | 554.2 |
| 252 | tubulin | Tubulin/FtsZ family | 2.4e−212 | 718.8 |
| 253 | ATP-synt_ab | ATP synthase alpha/beta family | 6.3e−108 | 372.0 |
| 254 | ATP-synt_A-c | ATP synthase Alpha chain, C terminal | 4.3e−106 | 313.5 |
| 255 | zf-C3HC4 | Zinc finger, C3HC4 type (RING finger) | 5e−12 | 43.2 |
| 256 | G-patch | G-patch domain | 1e−07 | 39.1 |
| 257 | CH | Calponin homology (CH) domain | 1.6e−11 | 51.7 |
| 258 | RF-1 | Peptidyl-tRNA hydrolase domain | 5.9e−66 | 232.5 |
| 259 | RF-1 | Peptidyl-tRNA hydrolase domain | 5.9e−66 | 232.5 |
| 261 | thiored | Thioredoxin | 2e−09 | 35.7 |
| 262 | thyroglobulin_1 | Thyroglobulin type-1 repeat | 3.1e−34 | 127.2 |
| 264 | DnaJ | DnaJ domain | 7.9e−13 | 56.0 |
| 267 | DUF6 | Integral membrane protein DUF6 | 0.083 | 9.1 |
| 268 | Ribosomal_L31e | Ribosomal protein L31e | 1.7e−61 | 217.7 |
| 270 | Zn_carbOpept | Zinc carboxypeptidase | 3.5e−50 | 180.1 |
| 272 | BTB | BTB/POZ domain | 7.7e−18 | 72.7 |
| 273 | Glycos_transf_1 | Glycosyl transferases group 1 | 0.027 | 12.8 |
| 277 | SPRY | SPRY domain | 2.5e−28 | 107.6 |
| 279 | BTB | BTB/POZ domain | 6e−27 | 103.0 |
| 280 | zf-C2H2 | Zinc finger, C2H2 type | 3.7e−116 | 399.3 |
| 281 | SCAN | SCAN domain | 2.4e−52 | 187.3 |
| 284 | NTP_transf_2 | Nucleotidyltransferase domain | 8.5e−13 | 55.9 |
| 288 | zf-C2H2 | Zinc finger, C2H2 type | 5.4e−93 | 322.4 |
| 289 | zf-C2H2 | Zinc finger, C2H2 type | 4.5e−124 | 425.6 |
| 291 | DiHfolate_red | Dihydrofolate reductase | 1.5e−63 | 221.6 |
| 293 | PDZ | PDZ domain (Also known as DHR or GLGF). | 7.4e−17 | 69.4 |
| 295 | PH | PH domain | 1.6e−08 | 35.4 |
| 296 | adh_short | short chain dehydrogenase | 4.5e−32 | 120.0 |
| 299 | BNR | BNR repeat | 3.1e−06 | 34.1 |
| 302 | HMG_box | HMG (high mobility group) box | 5.4e−05 | 20.0 |
| 303 | ig | Immunoglobulin domain | 0.05 | 11.6 |
| 304 | zf-C3HC4 | Zinc finger, C3HC4 type (RING finger) | 5e−12 | 43.2 |
| 305 | START | START domain | 0.013 | 4.8 |
| 306 | integrase | Integrase DNA binding domain | 7.2e−06 | 32.9 |
| 307 | myosin_head | Myosin head (motor domain) | 7.6e−279 | 939.7 |
| 308 | zf-C2H2 | Zinc finger, C2H2 type | 1.5e−53 | 191.4 |
| 309 | ig | Immunoglobulin domain | 0.00023 | 19.1 |
| 311 | ras | Ras family | 0.00079 | −93.3 |
| 312 | ig | Immunoglobulin domain | 2.1e−06 | 25.7 |
| 313 | EF1BD | EF-1 guanine nucleotide exchange domain | 4.3e−56 | 199.8 |
| 314 | Kelch | Kelch motif | 3.6e−94 | 326.2 |

TABLE 4-continued

| SEQ ID NO: | pFAM NAME | DESCRIPTION | p-value | pFAM SCORE |
|---|---|---|---|---|
| 315 | zf-C2H2 | Zinc finger, C2H2 type | 6.8e−59 | 209.1 |
| 317 | CNG_membrane | Transmembrane region cyclic Nucleotide Gated Channel | 1.5e−28 | 108.3 |
| 318 | Peptidase_S26 | Signal peptidase I | 2.8e−16 | 56.3 |
| 319 | zf-C2H2 | Zinc finger, C2H2 type | 4.6e−56 | 199.7 |
| 322 | EGF | EGF-like domain | 4.7e−08 | 40.2 |
| 323 | lectin_c | Lectin C-type domain | 6.6e−13 | 56.3 |
| 324 | MCT | Monocarboxylate transporter | 1.9e−50 | 181.0 |
| 327 | MAM | MAM domain. | 1.8e−51 | 184.4 |
| 329 | MAM | MAM domain. | 2e−179 | 609.5 |
| 330 | Sema | Sema domain | 9.9e−211 | 713.5 |
| 331 | zf-C2H2 | Zinc finger, C2H2 type | 1.5e−84 | 294.3 |
| 333 | PAP2 | PAP2 superfamily | 9.8e−10 | 45.8 |
| 334 | LRR | Leucine Rich Repeat | 2.8e−36 | 134.0 |
| 335 | AdoHcyase | S-adenosyl-L-homocysteine hydrolase | 1.2e−238 | 806.2 |
| 336 | TBC | TBC domain | 9.4e−38 | 138.9 |
| 343 | WD40 | WD domain, G-beta repeat | 8.7e−08 | 39.3 |
| 346 | globin | Globin | 3e−45 | 162.2 |
| 347 | globin | Globin | 7.5e−39 | 139.9 |
| 349 | F-box | F-box domain. | 8.5e−07 | 36.0 |
| 350 | HLH | Helix-loop-helix DNA-binding domain | 2e−08 | 41.4 |
| 351 | KRAB | KRAB box | 2.7e−39 | 144.0 |
| 352 | UCH-2 | Ubiquitin carboxyl-terminal hydrolase family 2 | 1.7e−19 | 78.2 |
| 353 | IPP_isomerase | Isopentenyl-diphosphate delta-isomerase | 9.5e−94 | 324.9 |
| 354 | IBR | IBR domain | 1.6e−12 | 55.0 |
| 355 | IBR | IBR domain | 1.6e−12 | 55.0 |
| 356 | SCP | SCP-like extracellular protein | 1.4e−34 | 128.3 |
| 358 | mito_carr | Mitochondrial carrier proteins | 3.9e−74 | 257.0 |
| 359 | Ribosomal_S8 | Ribosomal protein S8 | 6e−58 | 192.1 |
| 361 | UCH-2 | Ubiquitin carboxyl-terminal hydrolase family 2 | 6.7e−23 | 89.5 |
| 363 | Phage_lysozyme | Lysozyme | 9.3e−05 | 23.5 |
| 365 | Ribosomal_S2 | Ribosomal protein S2 | 3.3e−08 | 32.9 |
| 367 | zf-C3HC4 | Zinc finger, C3HC4 type (RING finger) | 5.3e−09 | 33.4 |
| 368 | zf-C3HC4 | Zinc finger, C3HC4 type (RING finger) | 0.0096 | 13.1 |
| 370 | TPR | TPR Domain | 0.041 | 20.5 |
| 373 | zf-C2H2 | Zinc finger, C2H2 type | 5.6e−109 | 375.5 |
| 374 | arf | ADP-ribosylation factor family | 4.9e−39 | 143.1 |
| 375 | BNR | BNR repeat | 0.033 | 20.8 |
| 376 | zf-C2H2 | Zinc finger, C2H2 type | 1.5e−24 | 95.0 |
| 379 | rrm | RNA recognition motif. (a.k.a. RRM, RBD, or RNP domain) | 0.00019 | 28.2 |
| 380 | rrm | RNA recognition motif. (a.k.a. RRM, RBD, or RNP domain) | 2.2e−19 | 77.9 |
| 383 | vwc | von Willebrand factor type C domain | 1.6e−31 | 118.2 |
| 384 | Ribosomal_L35Ae | Ribosomal protein L35Ae | 0.00013 | 7.0 |
| 388 | ras | Ras family | 3.9e−63 | 223.2 |
| 391 | F-box | F-box domain. | 2.3e−05 | 31.3 |
| 392 | bZIP | bZIP transcription factor | 6.3e−09 | 36.9 |
| 393 | SPRY | SPRY domain | 0.092 | −9.4 |
| 395 | zf-C2H2 | Zinc finger, C2H2 type | 3.1e−17 | 70.7 |
| 396 | SCAN | SCAN domain | 3.1e−39 | 143.8 |
| 397 | Kelch | Kelch motif | 1.1e−55 | 198.4 |
| 398 | C2 | C2 domain | 2.2e−80 | 280.4 |
| 399 | ank | Ank repeat | 1.8e−29 | 111.3 |
| 400 | ank | Ank repeat | 2.4e−19 | 77.7 |
| 403 | DAGKa | Diacylglycerol kinase accessory domain (presumed) | 1.9e−124 | 426.8 |
| 404 | MCT | Monocarboxylate transporter | 0.012 | −34.1 |
| 406 | PDZ | PDZ domain (Also known as DHR or GLGF). | 7.7e−46 | 165.7 |

TABLE 4-continued

| SEQ ID NO: | pFAM NAME | DESCRIPTION | p-value | pFAM SCORE |
|---|---|---|---|---|
| 407 | zf-C2H2 | Zinc finger, C2H2 type | 3.9e−48 | 173.3 |
| 408 | K_tetra | K+ channel tetramerisation domain | 2.6e−23 | 90.9 |
| 409 | SNF | Sodium: neurotransmitter symporter family | 0 | 1268.7 |
| 410 | ig | Immunoglobulin domain | 1.1e−06 | 26.5 |
| 411 | DnaJ | DnaJ domain | 9.9e−28 | 105.6 |
| 412 | mito_carr | Mitochondrial carrier proteins | 7.6e−66 | 228.6 |
| 413 | zf-C2H2 | Zinc finger, C2H2 type | 6e−97 | 335.5 |
| 414 | S_100 | S-100/ICaBP type calcium binding domain | 9.7e−13 | 55.8 |
| 416 | fn3 | Fibronectin type III domain | 8.6e−14 | 59.3 |
| 417 | zf-C2H2 | Zinc finger, C2H2 type | 3.8e−27 | 103.6 |
| 418 | zf-C3HC4 | Zinc finger, C3HC4 type (RING finger) | 4.4e−14 | 49.9 |
| 419 | pkinase | Eukaryotic protein kinase domain | 1.2e−54 | 195.0 |
| 420 | trypsin | Trypsin | 4.6e−38 | 122.5 |
| 421 | Glypican | Glypican | 5.7e−131 | 448.5 |
| 422 | Keratin_B2 | Keratin, high sulfur B2 protein | 0.0013 | −23.4 |
| 424 | zf-C2H2 | Zinc finger, C2H2 type | 0.00021 | 28.1 |
| 425 | ig | Immunoglobulin domain | 0.00074 | 17.5 |
| 426 | ig | Immunoglobulin domain | 2.9e−23 | 80.0 |
| 427 | Keratin_B2 | Keratin, high sulfur B2 protein | 0.0023 | −27.1 |
| 428 | pkinase | Eukaryotic protein kinase domain | 2.3e−55 | 197.3 |
| 429 | ig | Immunoglobulin domain | 4.1e−09 | 34.4 |
| 430 | Galactosyl_T | Galactosyltransferase | 1.8e−36 | 134.6 |
| 431 | proteasome | Proteasome A-type and B-type | 5.5e−28 | 106.4 |
| 432 | 7tm_1 | 7 transmembrane receptor (rhodopsin family) | 3.4e−38 | 123.5 |
| 433 | BTB | BTB/POZ domain | 8.1e−23 | 89.2 |
| 436 | p450 | Cytochrome P450 | 6.9e−175 | 594.4 |
| 437 | sugar_tr | Sugar (and other) transporter | 5.9e−65 | 229.2 |
| 438 | zf-C2H2 | Zinc finger, C2H2 type | 2.1e−52 | 187.5 |
| 439 | 7tm_1 | 7 transmembrane receptor (rhodopsin family) | 2.2e−40 | 130.4 |
| 440 | FGF | Fibroblast growth factor | 4.6e−14 | 51.6 |
| 441 | Osteopontin | Osteopontin | 3.7e−181 | 615.2 |

TABLE 5

| SEQ ID NO: | POSITION OF SIGNAL IN AMINO ACID SEQUENCE | maxS (MAXIMUM SCORE) | meanS (MEAN SCORE) |
|---|---|---|---|
| 2 | 1-32 | 0.995 | 0.681 |
| 4 | 1-37 | 0.979 | 0.718 |
| 22 | 1-31 | 0.947 | 0.775 |
| 25 | 1-30 | 0.924 | 0.720 |
| 27 | 1-28 | 0.982 | 0.649 |
| 39 | 1-27 | 0.983 | 0.898 |
| 40 | 1-17 | 0.991 | 0.955 |
| 46 | 1-22 | 0.990 | 0.921 |
| 56 | 1-18 | 0.925 | 0.822 |
| 58 | 1-18 | 0.981 | 0.951 |
| 62 | 1-28 | 0.939 | 0.749 |
| 64 | 1-33 | 0.979 | 0.757 |
| 72 | 1-41 | 0.989 | 0.690 |
| 81 | 1-26 | 0.960 | 0.674 |
| 85 | 1-18 | 0.979 | 0.963 |
| 86 | 1-22 | 0.967 | 0.792 |
| 89 | 1-25 | 0.980 | 0.867 |
| 99 | 1-16 | 0.973 | 0.925 |
| 100 | 1-24 | 0.978 | 0.760 |
| 101 | 1-17 | 0.978 | 0.925 |

TABLE 5-continued

| SEQ ID NO: | POSITION OF SIGNAL IN AMINO ACID SEQUENCE | maxS (MAXIMUM SCORE) | meanS (MEAN SCORE) |
|---|---|---|---|
| 115 | 1-18 | 0.887 | 0.579 |
| 117 | 1-18 | 0.952 | 0.670 |
| 122 | 1-42 | 0.977 | 0.587 |
| 139 | 1-21 | 0.966 | 0.848 |
| 142 | 1-25 | 0.993 | 0.954 |
| 155 | 1-28 | 0.909 | 0.664 |
| 158 | 1-18 | 0.954 | 0.747 |
| 176 | 1-23 | 0.913 | 0.597 |
| 177 | 1-20 | 0.986 | 0.936 |
| 180 | 1-42 | 0.978 | 0.689 |
| 182 | 1-32 | 0.929 | 0.583 |
| 186 | 1-21 | 0.979 | 0.941 |
| 194 | 1-21 | 0.930 | 0.662 |
| 202 | 1-45 | 0.985 | 0.714 |
| 214 | 1-37 | 0.992 | 0.855 |
| 227 | 1-24 | 0.971 | 0.882 |
| 230 | 1-20 | 0.979 | 0.911 |
| 239 | 1-17 | 0.982 | 0.964 |
| 253 | 1-13 | 0.918 | 0.692 |
| 254 | 1-13 | 0.918 | 0.692 |
| 258 | 1-20 | 0.912 | 0.693 |
| 259 | 1-20 | 0.912 | 0.693 |
| 262 | 1-26 | 0.974 | 0.824 |
| 264 | 1-18 | 0.965 | 0.833 |
| 269 | 1-25 | 0.956 | 0.765 |
| 290 | 1-16 | 0.912 | 0.705 |
| 291 | 1-18 | 0.896 | 0.634 |
| 292 | 1-19 | 0.966 | 0.897 |
| 296 | 1-18 | 0.991 | 0.973 |
| 297 | 1-20 | 0.906 | 0.580 |
| 301 | 1-27 | 0.957 | 0.652 |
| 309 | 1-19 | 0.983 | 0.871 |
| 312 | 1-22 | 0.968 | 0.844 |
| 322 | 1-23 | 0.952 | 0.812 |
| 326 | 1-27 | 0.982 | 0.911 |
| 329 | 1-18 | 0.983 | 0.941 |
| 330 | 1-18 | 0.932 | 0.884 |
| 334 | 1-27 | 0.990 | 0.923 |
| 337 | 1-45 | 0.983 | 0.793 |
| 338 | 1-45 | 0.983 | 0.793 |
| 348 | 1-29 | 0.991 | 0.729 |
| 356 | 1-22 | 0.978 | 0.877 |
| 366 | 1-26 | 0.939 | 0.709 |
| 367 | 1-22 | 0.966 | 0.843 |
| 378 | 1-29 | 0.961 | 0.842 |
| 382 | 1-16 | 0.951 | 0.777 |
| 404 | 1-44 | 0.975 | 0.876 |
| 410 | 1-33 | 0.977 | 0.822 |
| 420 | 1-17 | 0.989 | 0.969 |
| 421 | 1-23 | 0.974 | 0.799 |
| 425 | 1-18 | 0.981 | 0.952 |
| 429 | 1-21 | 0.982 | 0.912 |
| 431 | 1-30 | 0.936 | 0.679 |
| 432 | 1-43 | 0.978 | 0.712 |
| 436 | 1-28 | 0.993 | 0.948 |
| 437 | 1-43 | 0.930 | 0.624 |
| 440 | 1-24 | 0.993 | 0.810 |
| 441 | 1-16 | 0.978 | 0.939 |

SEQUENCE LISTING (441 sequences)

SEQ ID NO: 1 - DNA, 4003 bp, Homo sapiens
  CDS (427)..(3825)
gcttagataaacttaagagactagggtcctggatggaactttattattaacttcaagtttccttttaggcaggggaattattcccattcctaaaatgagggaatggaaatagatgttctatcatggctctaattctgtaaaagtgtaaaaagatggattacagtgatacaaatgtggtataaaaagttgtggaataagactggacttgtggttctttttcaacagtttaattgaaaagaaagacactcaatttttttcctttttctttattttcaggttatatttcacactatgtgctgactgtatctacagaagatatttaaaaaaaaaaaagataaactttttttcaaagattttgattccaggggaatctttgctttaaatttgtgtgtgtgtttgtgttcgtgaattgtaactccagaagcaatgcctgtacaagctccacaatggacggatttcctctcctgcccaatttgcactcagactttcgacgaaacaattcgaaagcccatcagtttgggttgtggccatactgtctgcaagatgtgcctgaataaactccaccgcaaggcttgcccatttgaccagaccactatcaatacagacattgagctcctccctgtgaactcagcattgctgcagctcgtgggtgctcaggtccctgagcagcagcctattactttgtgtagtggggttgaagacacaaagcattatgaggaagccaagaaatgtgtagaagaattagcattgtacttaaaaccgctcagcagtgctagaggagtgggtctgaacagcactactcagagtgttctgagtcgcccaatgcagaggaagcttgtgactctagtccactgtcaactagtagaagaagaaggcaggattcgtgccatgagggcagctcgatctttaggtgaacgaacagttacagagctcattctccagcaccagaatcctcagcaactctcttccaatctttgggcagcagtaagggctaggggatgccagttccttggaccagcaatgcaggaggaagctttaaagttggttctgctggccttagaagatggttctgctttgtcaagaaaagtattggttctgtttgtggtgcaaagattggagccacggtttcctcaagcctctaaaactagcattgggcatgttgttcagctcctttatagagcctcctgtttcaaggtcaccaaacgtgatgaagactcttctttgatgcagctgaaagaagaatttagaacctatgaagctctgcggcgagaacatgactcccagatagtgcagattgctatggaagcaggcttacgaattgcaccggaccagtggtcctctttgctttatggagaccagtctcacaaatctcatatgcagtccattattgacaagactccagcctcttttgcacagagtgttcaggaactaacaattgctctccagcgaactggagacccagcaaacttgaaccgactaagaccccatttggagctgttagcaaacattgaccctagtccagatgctcctcctcctacttgggaacagctggaaaatggcctggttgctgtgcgtacagtggtacatgggctggttgattatatccagaaccacagcaaaaaaggagcagatcagcagcagcctccacagcatagcaaatacaaaacatacatgtgtcgagatatgaagcagagaggaggatgccctcgtggggccagctgtacatttgcacactcacaggaggaactggaaaaatttcgtaaaatgaataagcgcctggttccgagaagacccttgagtgcctctttgggtcaacttaatgaggtgggcctgccttcagcagctatccttccagatgaaggtgcagtggatctccctagcagaaaacctcctgctctgccaaatggaattgtatcaacagggaatacagtaacacagcttattccgcgagggacagaccccagctatgattctagtctgaaaccaggaaaaatagatcatctgagcagtagtgctcctggatcccctcctgacctgctagaatctgttcctaagagtatttctgccttacctgtgaatccacattctatacctccaagggggccagcagatctgcctccaatgcctgttaccaaaccacttcagatggtacctcgaggttctcagttatatccagcacaacagacggatgtttattatcaggatcctcgaggagcagctccgccatttgaaccagcaccttatcagcagggtatgtattatactccaccaccacaatgtgtgtcccgctttgtccgacctccaccatctgctcctgaacctgctcctccctacttggatcattatccaccctacctccaagaacgtgttgtaaactctcagtatggcacacagccacagcagtacccacctatatacccatctcactatgatggccgtcgagtgtaccctgctccgtcttacacaagagaagagatattccgagaaagccctatacccattgagattccacctgcagcagtaccatcgtatgtaccagaatccagagaaagataccaacagatcgagagttactatccagtggctcctcatccaactcagatcagaccttcgtacctcagagaacctccttatagccggcttcctcctcctccccagcctcatcctagtctagatgaactacatcgccgacgaaaggaaataatggcccagctagaggaaagaaaggttatctctccacctccttttgcaccttcaccaaccttgcctcctacctttcatccggaagaatttttggatgaagacttgaaggtagctgggaaatacaaaggaaatgattatagccaatactctccctggtcatgtgacaccatcggctcctacattggaaccaaagatgcaaaacccaaagatgttgtggcagcagggagtgtggaaatgatgaatgtggagagtaaaggaatgagggaccagcgattagatcttcagagaagagcagcagaaaccagtgatgatgacctcatcccatttggagaccgaccaacagtgtctcggtttggtgccatctcacgaacttccaaaactatatatcagggtgctggtccaatgcaggctatggcacctcagggagctcctacaaaatctattaacatttcagattatagtccatatggaacccacggtggctggggagcttctccatattcacctcatcaaaacataccttctcagggacacttcagtgagagggagagaatatctatgtcagaagtggccagtcatggaaaaccccttccatctgctgagagagaacagctacgactagaattgcagcaattgaaccatcagattagccagcagacccagctacgtggactagaggctgttagtaacaggctggtgttgcagagggaggcaaacaccctggcaggccagtcacagcccccaccaccgccacctccaaaatggcctgggatgatctcaagtgagcagttgagcttggaactgcaccaggtggaaagggaaatcgggaagagaacacgggaactgagtatggaaaaccagtgttctctggacatgaaaagcaaactgaatacaagtaaacaagcagaaaatggacaaccagaaccacaaaacaaggttccggctgaggaccttacattgacattcagcagtgatgtaccaaatggatcagccttgacacaagagaatatcagcctcctatcaaacaagaccagctctctgaacctgtcagaggaccctgagggaggaggggataataatgactcccagagatcaggagttactcccagttctgctccttaaaatatgaggagtcctacttttatcttctgctcctaatcagtttgtcgggcataggggtaggagaacgcataattctaaattttctcttaagagcggtcagagaaatcaggaattcaccagagcaatgtgcacaaacaccatactaaaaacaaacctgcacatagttcacattatgcat

SEQ ID NO: 2 - DNA, 1793 bp, Homo sapiens
  CDS (756)..(1667)
cggctgcggaggcgatctccctgatttagggttttagttgcccggagcctgccaccgctctcagccagcccgcatccttctctgttcttccctccccccgcctgccacggcgcgggtatccgcagccacagcccggggccggtgaggcggcgaagggggaggggaggaatcaagggatgagcgccggaagggcgtcgggggccctgagccgcactaggacgcccctggagccggaaccccagcagaagccggaaccagaaccaaatcaccggtaccgggtcggccaggtggtcagggtgggagaaaccaaaaagggagaggggtgcgggagtactgagaggaaggggctgcaaaggcctggctcaggccggcgtggaggaggtgcgggcgctgactcaggcaggatttctgctcccgccgcctaagaatgccgtcccatctcgtgctgcagtgtccttgggagggacagaagcgcgaacaagctggaaaggggaacgctcggggcgtcggggaagcgggaccagggtcgtggtagagagcttgcgttgccgctgacctcttgccgaaaggcgaaacagcactcctggcccggacagctccctggttgggtagggggtggggccggacctcagccggacgtcttagacgtgcttgtttcagatcctgaggacggcattcctacccctcccccattcccagctgcagccccctaaacccaggaggcgccctggcccgcgctcgccccccagggcctcatgtcggaaccacagcctgacctggaaccgccccaacatgggctatatatgctcttcctgcttgtgctggtcttcttcctcatgggcctggtaggcttcatgatctgccacgtgctcaagaagaagggctaccgctgccgcacgtcgaggggctctgagcctgacgatgcccagcttcagccccctgaggacgatgacatgaatgaggacacagtagagaggattgttcgctgcatcatccagaatgaagccaatgctgaggccttgaaggagatgctgggggacagtgaaggagaagggacagtgcagctgtccagtgtggatgccacctccagcctgcaggacggagccccctcccatcatcacacagtgcacctgggctctgcagccccttgcctccattgcagccgcagcaagaggcctccacttgtccgtcagggacgctccaaggaaggaaaaagccgcccccggacaggggagaccactgtgttctctgtgggcaggttccgggtgacacacattgagaagcgctatggactgcacgaacaccgtgatggctcccccacagacaggagctggggctctggtgggggacaggacccagggggtggtcaggggtctgggggagggcagcccaaggcagggatgcctgccatggagaggctgccccctgagaggccacagccccaggtcctagccagccccccagtacagaatggaggactcagggacagcagcctaacccctcgtgcacttgaagggaaccccagagcttctgcagagccaacactgagggccggagggaggggcccaagcccagggctgcccactcaagaggcaaatgggcagccaagcaaaccagacacttctgatcaccaggtgtctctaccacagggagcagggagtatgtgagtctccttcattgtgctgatggactaccagctggcagggccagggggtgggtgggcgtgaaagccctcccctccactggacagcactgccccccagctgagggaccagctctacttccacctggag

SEQ ID NO: 3 - DNA, 2885 bp, Homo sapiens
  CDS (120)..(1442)
ggcttcctgggctgagtccgcccgcggtcccggcggcgccaggtgcgttcactctgcccggctccagccagcgtccgccgccgccgtagctgccccaggctccccgccccgctgccgagatggcgacgcgctcctgtcgggagaaggctcagaagctgaacgagcagcaccagctcatcctatccaagcttctgagggaggaggacaacaagtactgcgccgactgcgaggccaaaggtcctcgatgggcttcctggaatattggtgtgtttatttgcatcagatgtgctggaattcatagaaatcttggggttcatatatccagggtcaaatcagtcaacctagaccaatggacagcagaacagatacagtgcatgcaagatatgggaaatactaaagcaagactactctatgaagccaatcttccagagaactttcgaagaccacagacagatcaagcagtggaatttttcatcagagataaatatgaaaagaagaaatactacgataaaaatgccatagctattacaaataaagaaaaaaaaaaaaaaagggaagagaaaaagagagaaaaggagccagaaaagccggcaaaaccacttacagctgaaaagctgcagaagaaagatcagcaactggagcctaaaaaaagtaccagccctaaaaaagctgcggagcccactgtggatcttttaggacttgatggccctgctgtggctccagtgaccaacgggaacacaacggtgccacccctgaacgatgatctggacatctttggaccgatgatttctaatcccttacctgcaactgtcatgcccccagctcaggggacaccctctgcaccagcagctgcaaccctgtctacagtaacatctggggatctagatttattcactgagcaaactacaaaatcagaagaagtggcaaagaaacaactttccaaagactccatcttatctctgtatggcacaggaaccattcaacagcaaagtactcctggtgtatttatgggacccacaaatataccatttacctcacaagcaccagctgcatttcagggctttccatcgatgggcgtgcctgtgcctgcagctcctggccttataggaaatgtgatgggacagagtccaagcatgatggtgggcatgcccatgcccaatgggtttatgggaaatgcacaaactggtgtgatgccacttcctcagaacgttgttggcccccaaggaggaatggtgggacaaatgggtgcaccccagagtaagtttggcctgccgcaagctcagcagccccagtggagcctctcacagatgaatcagcagatggctggcatgagtatcagtagtgcaacccctactgcaggttttggccagccctccagcacaacagcaggatggtctggaagctcatcaggtcagactctcagcacacaactgtggaaatgaaaactgcaatacaagtttcatccagaactaccacctgacattccttgctgaaacgcatctagttcccctgtttattcatatgcatattttttttctttttacccatttgttcatattaagaatgatctgattgaccgtgttggtctgtactgattcaatttgatgtggtgaaaagcaggttgataaatcattttatgtcaagggcagctttgctcatatttcccatgatttcatgtactgcattatttgagaagctgctcaacttgcaaaatcagttttcctctcaataaaattatagctctaatgtttgcatataagggaagtagttatcatgttagtaatacctctaatagtataaaccccaccccaaaattagccagtaatcctgtaggaaggtactgtatgatcaaatgtttaatcatataaatagaatgtaaatgtctcactgagcactgttttctagtgtatcaaaatgctcttatttcatcattcacttcactgtgctgttgttatgatgtgcttaacagggaacgtgattagtgaaaggaagataaacgtggatgttactccaaaacttcgtttaatgaatgcttaaagaattcaaattttatctgcctctcttgtaatttggatctcttcttaatgtacatagtgctaacatgaagacctttttctgcactatatgcaaacagggtaactaactaaaacaaagccactttcaatcttcaatccttgaaggtatatctaggtttatgacagtaattgtgtttacattttatggtgcctagtattgacaaaatgttatttccctacattaaacatgactccatagaccttttcatttgtgggtttttatttcctatgatgtatactgccactaaccttccaaaaattacttagtattgcaaagtcaggaatcatcaagaacgtttagctgacaaaatacttgtctgttttaaaaacctggtcaagactaccaacctcgtcaagtctaccaattataagggcaaattggagaaaaagaaagaatatatactcaagagtggtatcttgcagtatcggcactgtacaaaaaaatcttccaatttagttgatgcagagaaaacatgcagaacaaatgaagacaaaacatacattttgtaccaaccatccaattagcttatgttaactgacaagctccatttaaacagatgtccatcagatgacaagaaaggctgctgtactgaagtaaaacaaacaatacctgaatgctctgtagcctaaactccaaacatcctcttccatatggatccactggctgggacaaactgcaccagttgctgcttcaatttatacctcaattttcactgtgtccagggtgggtactttgggctcgttgggctaggatttaaccttcttctgtccgagtgtggccacacgaggaacctggaagggggaagggaa

SEQ ID NO: 4 - DNA, 1394 bp, Homo sapiens
  CDS (4)..(711)
aagatggctgtggagctgggcgtgctgctcgtccggccccggcccggaaccgggctgggtagagtgatgcggaccctcctgctggtgctgtggctggcgacgcgcggaagcgcgctctactttcacatcggagagacggagaagaagtgctttattgaggagatcccggacgagaccatggtcataggaaactaccggacgcagctgtatgacaagcagcgggaggagtaccagccggccaccccggggcttggcatgtttgtggaggtgaaggacccagaggacaaggtcatcctggcccggcagtatggctccgagggcaggttcactttcacttcccatacccctggtgagcaccagatctgtcttcactccaattccaccaagttctccctctttgctggaggcatgctgagagttcacctggacatccaggtaggtgaacatgccaatgactatgcagaaattgctgctaaagacaagttgagtgagttgcagctacgagtgcgacagctggtggaacaagtggagcagatccagaaagagcagaactaccagcggtggcgagaggagcgcttccggcagaccagtgagagcaccaaccagcgggtgctgtggtggtccattctgcagaccctcatcctcgtggccatcggtgtctggcagatgcggcacctcaagagcttctttgaagccaagaagcttgtgtagctgtcccaggcgtcacaacccatcctcccaggctgggggagaaaggacctcctggaactgacttcttctgtcaggaggactggtttccagccatacctgttctggaagggagaggggctggaggcacccacaggcacaagctgaaggcagcagcttggctaatactgagcaggtagtggggcaaattcctgccctctctctctggcctctgggccgtttggtagtaatcacccaggggctggtaaagcccctcctcttggcacctcagaatcacagtgttactgatcagggatgtgaggctgctgttgggggtggggggaggggaatgggcaggcaagccagtcttctgtcttcctttgctaacttagggttttgagcaggttggggtatggtgcctgtcatacccacctgccaccctgggaacctcactgttctctctttcagcctagacctgctgatccagggtgtgtgtgagttgagggtgggtggaggggtttgcagtgtgggaatgtggccctgcagttgacctgagctgcttcacatggttgtccattctggggcttaaagaactgggaccagaccaagtagaggccttggtgctggttggggtggggcctgcagagtcttagttactgatttcattttcaataaatgtaggtttgttacatgagtttcccaataaa

SEQ ID NO: 5 - DNA, 3505 bp, Homo sapiens
  CDS (384)..(2939)
acctcacggccggagattcccgggtcgacccacgcgtccggagcaatggatgaataaacatttgttccctttcataaagccctgggattctgctttgtctaccttaagtttatttctctaaatgatctgtcatggaaagaggatattttggtatgtttctgcttttttgcatgtgacccagaatacgttggagagatgaaattagacttgttacctctattttatgtacacttaacttagaatatattaacttagaatatattgtgaattaatgggttttaaaacatttaattattggactaaccattattaccattaaaacatttgttttatttttcaggatttgttttcttcaagcatttggtcgagattaagaattaaaaatgtcatccaaacaagaaataatgagtgaccagcggtttagacgggttgcaaaggacccgagattttgggaaatgccagaaaaggatcgaaaagtcaaaattgacaagagatttcgagccatgtttcatgacaagaagttcaagttgaactatgccgtggataaaagagggcgccccattagccatagcactacagaggatttgaagcgtttttacgacctttcagattctgattccaatctctctggtgaagatagcaaagcattgagtcaaaagaaaataaagaagaaaaaaacccagactaaaaaagaaatcgattcaaaaaatctagttgagaaaaagaaagaaaccaagaaggctaatcacaagggttctgaaaataaaactgatttagataattctataggaattaaaaaaatgaaaacctcatgtaaatttaagatagattcaaacataagtccgaagaaggatagcaaagaatttacacaaaaaaataaaaaaaaaaaaaaaaacattgttcaacatactacagactcttctctcgaagaaaaacaaaggacattagactcaggcacctctgaaattgtgaaatctcccagaatcgagtgttctaagacaagaagagaaatgcaatcagtggttcaactcataatgacaagagacagtgatggttatgaaaacccaacagatggtgaaatgtgtgacaaagatgctctggaggaagattcagaaagcgttagtgaaataggaagtgatgaggaatctgaaaatgaaattacaagtgttggtagagcttcaggtgatgacgatggaagtgaagatgatgaagaggaggatgaagatgaagaggaggatgaagatgaggatagtgaggatgatgataaaagtgacagtggccctgatcttgcaaggggtaaaggaaatatagaaactagttctgaagatgaagatgatacggcagatttgtttccagaagaatctggttttgagcatgcttggagagaattagataaagatgctcctcgtgctgatgagattacacgtcgattagcagtttgtaacatggactgggatagattaaaggcaaaagatttgctggctctgttcaattcatttaaacccaaaggaggtgtaatattttccgtcaagatatatccttcagaatttggaaaggagaggatgaaggaagagcaagttcaaggaccagtagagctattaagtattcctgaagatgccccagaaaaagactggacgtctagagaaaaattgagagattatcaattcaaacgactgaagtactattatgcagtagtagactgtgattctccggaaacagctagtaaaatttatgaggattgtgatggcctggaatttgaaagtagttgttctttcatagatctaaggtttataccagatgatattacttttgatgatgagcctaaggatgtagcctcagaagtgaatttaacagcatataaaccaaaatatttcacttctgctgcaatgggaacatcaacggtggaaatcacttgggatgagactgatcatgaaagaattacaatgctcaacaggaagtttaaaaaggaagagcttttggacatggattttcaagcctacttagcttcctctagtgaagatgaagaggagacagaagaggagctacaaggtgatgatggagtcaatgtagaagaagatgggaaaacaaagaaaagtcagaaggatgatgaagaacaaattgctaaatacaggcagctcttgcaggttattcaaaaaaaaaaaaaaaaaggcaaagaaaatgatatggaaatggaaattaaatgggttccaggtcttaaagaaagtgcagaagagatggtcaaaaacaaattggaaggaaaggataaactgaccccttgggaacaatttttagagaagaagaaagagaaaaaaagactgaaaaggaaacagaaggctcttgctgaagaggccagtgaagaggaacttccctctgatgttgatttgaatgacccatactttgctgaagaagttaaacaaataggtataaataaaaaatcggtaaaatctgcaaaagatggcacatctccagaagaagaaattgaaatagaaagacaaaaggctgaaatggctttgcttatgatggatgaggacgaggacagtaagaaacacttcaattacaacaagattgtggagcaccagaatctgagcaaaaagaagaaaaagcagctcatgaaaaagaaggaattaatagaggatgactttgaggtaaatgttaacgatgcacggtttcaggcaatgtacacttcccacttgttcaatttggacccctcagatcccaatttcaagaaaacaaaagctatggaaaaaatccttgaggagaaggcccggcaaagagaacggaaagaacaagaacttactcaggcaataaagaaaaaagagagtgagattgaaaaggaatcacaaaggaagtccattgatcctgctttgtcaatgttgattaaatctataaaaaccaaaacagagcagtttcaagcaagaaaaaagcaaaaagtcaaataactggatgttacttatttttgaactgaatacatcttttcctaaaatgtacaaaaatagtaggagggaatatttattgggaacaaagctatctttcaagaacatgaataaaatctttttctggacatagtaaaatttttctccataaataattgtacttaattgtggatgactgacaaatttttattgtatattcctacagatcagtcataattaaattacctgcattatagggtttataaaatttttatattttacaatgttcagttctaactagtggaaagttactctagctttttaaaaggctgtttacaattctgtgtaaaaatagagcagtatctactcaagtttgtgtaaatgttagggataatttgaaaaatatatatatttaatacattaatttctctggaagcaggaggcatgtttaaataactattaaaataatttatttttctagccataaaggatggaagtcaagaactttttgttgtttagtcatgttaagtatagtttatgaaattaacttgtaaataaaagtgtaaaatattttcattaaaaaaaaaaaaaaa

SEQ ID NO: 6 - DNA, 762 bp, Homo sapiens
  CDS (206)..(643)
atacgaagaactcggttggcctcgttggctgcatcgaggaagtgtcgcacaatgccatcgccgtctactggaatccgctggagagctccgccaagtgcacctcagaatcaacccacactgctttgcgttcgcagcctttccgcttcctgtttttccctccgaccaaccccgagcgcaaagaaattgacctcgcagcggtcctacaatgcttttatatcattggccaagctttaccccgcccctgcctcatgcagcctatgggctaggctttagggtccgcggttggtcagaccggggcacttggcctgaagacctggaattggcgacttcgatattaacaaggatggcggcggccgcagcaagtcgaggagtcggggcaaagctgggcctgcgtgagattcgcatccacttatgtcagcgctcgcccggcagccagggcgtcagggacttcattgagaaacgctacgtggagctgaagaaggcgaatcccgacctacccatcctaatccgcgaatgctccgatgtgcagcccaagctctgggcccgctacgcatttggccaagagacgaatgtccctttgaacaacttcagtgctgatcaggtaaccagagccctggagaacgttctaagtggtaaagcctgaagcctccactgaggattaagagcaacagccccagagcctgggctctgctggacttagtataatgtgaaaaaaatgtgttctcctattcctcataaagcttgtgctgtaaaaaaaaaaaa

SEQ ID NO: 7 - DNA, 2692 bp, Homo sapiens
  CDS (303)..(2417)
gcacgagggggacacaagatggcggcagcggcgctggggagggcgaggcggaggcggcaaaacgggcggtcgagcagaacgtgtagccgcgtcccctccagtccgctccgggcagctgctgatgcaaggaatcccctgggctcccgtccactccactgctgaccagcccattcgcctgtgctgagtcttcctgcaggcctttccttgcctctgtgggaccctgtgggggtccatccggctggagaagaaaagcctctcatgctaacgttgcagaccccagagggtcctgtgtgggtgtggagatggccaatgagaatcacggcagcccccgggaggaagcgtccctgctgagtcactccccaggtacctccaatcagagccagccctgttctccaaagccaatccgcctggttcaggacctcccagaggagctggtgcatgcaggctgggagaagtgctggagccggagggagaatcgtccctactacttcaaccgattcaccaaccagtccctgtgggagatgcccgtgctggggcagcacgatgtgatttcggaccctttggggctgaatgcgaccccactgccccaagactcaagcttggtggaaactcccccggctgagaacaagcccagaaagcggcagctctcggaagagcagccaagcggcaatggtgtgaagaagcccaagattgaaatcccagtgacacccacaggccagtcggtgcccagctcccccagtatcccaggaaccccaacgctgaagatgtggggtacgtcccctgaagataaacagcaggcagctctcctacgacccactgaggtctactgggacctggacatccagaccaatgctgtcatcaagcaccgggggccttcagaggtgctgcccccgcatcccgaagtggaactgctccgctctcagctcatcctgaagcttcggcagcactatcgggagctgtgccagcagcgagagggcattgagcctccacgggagtctttcaaccgctggatgctggagcgcaaggtggtagacaaaggatctgaccccctgttgcccagcaactgtgaaccagtcgtgtcaccttccatgtttcgtgaaatcatgaacgacattcctatcaggttatcccgaatcaagttccgggaggaagccaagcgcctgctctttaaatatgcggaggccgccaggcggctcatcgagtccaggagtgcatcccctgacagtaggaaggtggtcaaatggaatgtggaagacacctttagctggcttcggaaggaccactcagcctccaaggaggactacatggatcgcctggagcatctgcggaggcagtgtggcccccacgtctcggccgcagccaaggactccgtggaaggcatctgcagtaagatctaccacatctccctggagtacgtcaaacggatccgagagaagcaccttgccatcctcaaggaaaacaacatctcagaggaggtggaggcccctgaggtggagccccgcctagtgtactgctacccagtccggctggctgtgtctgcaccgcccatgcccagcgtggagatgcacatggagaacaacgtggtctgcatccggtataagggagagatggtcaaggtcagccgcaactacttcagcaagctgtggctcctttaccgctacagctgcattgatgactctgcctttgagaggttcctgccccgggtctggtgtcttctccgacggtaccagatgatgttcggcgtgggcctctacgaggggactggcctgcagggatcgctgcctgtgcatgtctttgaggccctccaccgactctttggcgtcagcttcgagtgcttcgcctcacccctcaactgctacttccgccagtactgttctgccttccccgacacagacggctactttggctcccgcgggccctgcctagactttgctccactgagtggttcatttgaggccaaccctcccttctgcgaggagctcatggatgccatggtctctcactttgagagactgcttgagagctcaccggagcccctgtccttcatcgtgttcatccctgagtggcgggaacccccaacaccagcgctcacccgcatggagcagagccgcttcaaacgccaccagttgatcctgcctgcctttgagcatgagtaccgcagtggctcccagcacatctgcaagaaggaggaaatgcactacaaggccgtccacaacacggctgtgctcttcctacagaacgaccctggctttgccaagtgggcgccgacgcctgaacggctgcaggagctgagtgctgcctaccggcagtcaggccgcagccacagctctggttcttcctcatcgtcctcctcggaggccaaggaccgggactcgggccgtgagcagggtcctagccgcgagcctcaccccacttaacatatcctgcggggaggaggagccccaggggtgctagtctggactgctgggactcgggcccctggggcctcagagggaccccggctgccactgacatatgaagattatggttctgccagggctcccctccctgcctgtccccaagtcctcacctcaaactccctccaagtcccatgtatataggtcctgatgccttcccaaccccgcccctcaccctgttgccaccttgtttcatttgtaaaaggaaatacagaaacccccccaaaaaaaaaaaa

SEQ ID NO: 8 - DNA, 2781 bp, Homo sapiens
  CDS (303)..(2378)
gcacgagggggacacaagatggcggcagcggcgctggggagggcgaggcggaggcggcaaaacgggcggtcgagcagaacgtgtagccgcgtcccctccagtccgctccgggcagctgctgatgcaaggaatcccctgggctcccgtccactccactgctgaccagcccattcgcctgtgctgagtcttcctgcaggcctttccttgcctctgtgggaccctgtgggggtccatccggctggagaagaaaagcctctcatgctaacgttgcagaccccagagggtcctgtgtgggtgtggagatggccaatgagaatcacggcagcccccgggaggaagcgtccctgctgagtcactccccaggtacctccaatcagagccagccctgttctccaaagccaatccgcctggttcaggacctcccagaggagctggtgcatgcaggctgggagaagtgctggagccggagggagaatcgtccctactacttcaaccgattcaccaaccagtccctgtgggagatgcccgtgctggggcagcacgatgtgatttcggaccctttggggctgaatgcgaccccactgccccaagactcaagcttggtggaaactcccccggctgagaacaagcccagaaagcggcagctctcggaagagcagccaagcggcaatggtgtgaagaagcccaagattgaaatcccagtgacacccacaggccagtcggtgcccagctcccccagtatcccaggaaccccaacgctgaagatgtggggtacgtcccctgaagataaacagcaggcagctctcctacgacccactgaggtctactgggacctggacatccagaccaatgctgtcatcaagcaccgggggccttcagaggtgctgcccccgcatcccgaagtggaactgctccgctctcagctcatcctgaagcttcggcagcactatcgggagctgtgccagcagcgagagggcattgagcctccacgggagtctttcaaccgctggatgctggagcgcaaggtggtagacaaaggatctgaccccctgttgcccagcaactgtgaaccagtcgtgtcaccttccatgtttcgtgaaatcatgaacgacattcctatcaggttatcccgaatcaagttccgggaggaagccaagcgcctgctctttaaatatgcggaggccgccaggcggctcatcgagtccaggagtgcatcccctgacagtaggaaggtggtcaaatggaatgtggaagacacctttagctggcttcggaaggaccactcagcctccaaggaggactacatggatcgcctggagcatctgcggaggcagtgtggcccccacgtctcggccgcagccaaggactccgtggaaggcatctgcagtaagatctaccacatctccctggagtacgtcaaacggatccgagagaagcaccttgccatcctcaaggaaaacaacatctcagaggaggtggaggcccctgaggtggagccccgcctagtgtactgctacccagtccggctggctgtgtctgcaccgcccatgcccagcgtggagatgcacatggagaacaacgtggtctgcatccggtataagggagagatggtcaaggtcagccgcaactacttcagcaagctgtggctcctttaccgctacagctgcattgatgactctgcctttgagaggttcctgccccgggtctggtgtcttctccgacggtaccagatgatgttcggcgtgggcctctacgaggggactggcctgcagggatcgctgcctgtgcatgtctttgaggccctccaccgactctttggcgtcagcttcgagtgcttcgcctcacccctcaactgctacttccgccagtactgttctgccttccccgacacagacggctactttggctcccgcgggccctgcctagactttgctccactgagtggttcatttgaggccaaccctcccttctgcgaggagctcatggatgccatggtctctcactttgagagactgcttgagagctcaccggagcccctgtccttcatcgtgttcatccctgagtggcgggaacccccaacaccagcgctcacccgcatggagcagagccgcttcaaacgccaccagttgatcctgcctgcctttgagcatgagtaccgcagtggctcccagcacatctgcaagaagtgggtgccagggagggcaggggaaggaggctgggctggccaggccaggcccagccccaccctgagccattgcctttgcccgcagggaggaaatgcactacaaggccgtccacaacacggctgtgctcttcctacagaacgaccctggctttgccaagtggggcgccgacgcctgaacggctgcaggagctgagtgctgcctaccggcagtcaggccgcagccacagctctggttcttcctcatcgtcctcctcggaggccaaggaccgggactcgggccgtgagcagggtcctagccgcgagcctcaccccacttaacatatcctgcggggaggaggagccccaggggtgctagtctggactgctgggactcgggcccctggggcctcagagggaccccggctgccactgacatatgaagattatggttctgccagggctcccctccctgcctgtccccaagtcctcacctcaaactccctccaagtcccatgtatataggtcctgatgccttcccaaccccgcccctcaccctgttgccaccttgtttcatttgtaaaaggaaatacagaaacccccccaagaaaaaaaaaaaa

SEQ ID NO: 9 - DNA, 1597 bp, Homo sapiens
  CDS (103)..(1533)
gtcacaccaaaatatgaaatatgaatcggaatgtgcttctgggaagataggtggctgagccgaggttgtggagagccctgacgttaacttgaagaatctgccatgtccacgcagagacttcggaatgaagactaccacgactacagctccacggacgtgagccctgaggagagcccgtcggaaggcctcaacaacctctcctccccgggctcctaccagcgctttggtcaaagcaatagcacaacatggttccagaccttgatccacctgttaaaaggcaacattggcacaggactcctgggactccctctggcggtgaaaaatgcaggcatcgtgatgggtcccatcagcctgctgatcataggcatcgtggccgtgcactgcatgggtatcctggtgaaatgtgctcaccacttctgccgcaggctgaataaatcctttgtggattatggtgatactgtgatgtatggactagaatccagcccctgctcctggctccggaaccacgcacactggggaagacgtgttgtggacttcttcctgattgtcacccagctgggattctgctgtgtctattttgtgtttctggctgacaactttaaacaggtgatagaagcggccaatgggaccaccaataactgccacaacaatgagacggtgattctgacgcctaccatggactcgcgactctacatgctctccttcctgcccttcctggtgctgctggttttcatcaggaacctccgagccctgtccatcttctccctgttggccaacatcaccatgctggtcagcttggtcatgatctaccagttcattgttcagaggatcccagaccccagccacctccccttggtggccccttggaagacctaccctctcttctttggcacagcgattttttcatttgaaggcattggaatggttctgcccctggaaaacaaaatgaaggatcctcggaagttcccactcatcctgtacctgggcatggtcatcgtcaccatcctctacatcagcctggggtgtctggggtacctgcaatttggagctaatatccaaggcagcataaccctcaacctgcccaactgctggttgtaccagtcagttaagctgctgtactccatcgggatctttttcacctacgcactccagttctacgtcccggctgagatcatcatccccttctttgtgtcccgagcgcccgagcactgtgagttagtggtggacctgtttgtgcgcacagtgctggtctgcctgacatgcatcttggccatcctcatcccccgcctggacctggtcatctccctggtgggctccgtgagcagcagcgccctggccctcatcatcccaccgctcctggaggtcaccaccttctactcagagggcatgagccccctcaccatctttaaggacgccctgatcagcatcctgggcttcgtgggctttgtggtggggacctatgaggctctctatgagctgatccagccaagcaatgctcccatcttcatcaattccacctgtgccttcatatagggatctgggttcgtctctgcagctgcctacccctgccccatgtgtcccccgttacctgtcctca

SEQ ID NO: 10 - DNA, 2198 bp, Homo sapiens
  CDS (124)..(891)
agaggactccaagcgccatggccgctgccgcccgagcccgggtcgcgtacttgctgaggcaactgcaacgcgcagccccctggactttcaccttctgggaaaacaacagattatgcctttgagatggctgtttcaaatattagatatggagcagcagttacaaaggaagtaggaatggacctaaaaaacatgggtgctaaaaatgtgtgcttgatgacagacaagaacctctccaagctccctcctgtgcaagtagctatggattccctagtgaagaatggcatcccctttacggtttatgataatgtgagagtggaaccaacggattcaagcttcatggaagctattgagtttgcccaaaagggagcttttgatgcctatgttgctgtcggtggtggctctaccatggacacctgtaaggctgctaatctgtatgcatccagccctcattctgatttcctagattatgtcagtgcccccattggcaagggaaagcctgtgtctgtgcctcttaagcctctgattgcagtgccaactacctcaggaaccgggagtgaaactactggggttgccatttttgactatgaacacttgaaagtaaaaattggcatcacttcgagagccatcaaacccacactgggactgattgatcctctgcacaccctccacatgcctgcccgagtggtcgccaacagtggctttgatgtgctttgccatgccctggagtcatacaccaccctgccctaccacctgcggagcccctgcccttcaaatcccatcacacggcctgcgtaccagggcagcaacccaatcagtgacatttgggctatccacgcgctgcggatcgtggctaagtatctgaagagggccgtcaacagcactgacaaatgaagaagaagaatgagtctcagggcaccttcctggagtggccctcgccatccagggaccagcgcgttgcctcccccggcgcttttacatcacatgagcagctgacagcgtatttattatgcctttgctgaaacagttgatgagaaatatgtttcccttcagttttcatttagaagacaaggcgtcgtttgaataacttgcctgatttttcttcctaccgagtagcatttctttttttttcaccatatctttccctaaggcagctccttattctgtaggaattgccaatgttgatgtgttattgttaggtatttatatcattcacagggctgtcagaaatcccgatgatcttgaagcaaggtctcatatgcacttggcaagtgcttttgctggcatcggctttggaaatgctggtgttcatctgtgccatggaatgtcttacccaatttcaggtttagtgaagatgtataaagcaaaggattacaatgtggatcacccactggtgccccatggcctttctgtggtgctcacgtccccagcggtgttcactttcacggcccagatgtttccagagcgacacctggagatggcagaaatactgggagccgacacccgcactgccaggatccaagatgcagggctggtgttggcagacacgctccggaaattcttattcgatctggatgttgatgatggcctagcagctgttggttactccaaagctgatatccccgcactagtgaaaggaacgctgccccaggaaagggtcaccaagcttgcaccccgtccccagtcagaagaggatctggctgctctgtttgaagcttcaatgaaactgtattaattgtcattttaactgaaagaattaccgctggccattgtagtgctgagagcaagagctgatctagctagggctttgtcttttcatctttgtgcataacttacctgttaccagtataggtgggatatacatttatcttgcaggaaattccccaaagctcagagtccagttccttccataaaacaggctggacaaatgaccactatgttagacccccaggctcgacttcaggggtcagtgttcctgtcccaaaccccacacagaatactctgcctctgcttcatgtagcaaatgagcaaaaactcagtatctatcaaaagtgtaaattatatttcctatgcctagtaattcacttcatgtctaaaaatttatctgatagaaacactagcaccagtacatacagaagcatggcaaggatgtttctggcagcacttttctaataataaaagatttgaaacaaaaaaaaaaa

SEQ ID NO: 11 - DNA, 2256 bp, Homo sapiens
  CDS (36)..(947)
gagcgacccgaggagggaagaggactccaagcgccatggccgctgccgcccgagcccgggtcgcgtacttgctgaggcaactgcaacgcgcagcgtgccagtgcccaactcattctcatacttactcccaagcccctggactttcaccttctgggaaaacaacagattatgcctttgagatggctgtttcaaatattagatatggagcagcagttacaaaggaagtaggaatggacctaaaaaacatgggtgctaaaaatgtgtgcttgatgacagacaagaacctctccaagctccctcctgtgcaagtagctatggattccctagtgaagaatggcatcccctttacggtttatgataatgtgagagtggaaccaacggattcaagcttcatggaagctattgagtttgcccaaaagggagcttttgatgcctatgttgctgtcggtggtggctctaccatggacacctgtaaggctgctaatctgtatgcatccagccctcattctgatttcctagattatgtcagtgcccccattggcaagggaaagcctgtgtctgtgcctcttaagcctctgattgcagtgccaactacctcaggaaccgggagtgaaactactggggttgccatttttgactatgaacacttgaaagtaaaaattggcatcacttcgagagccatcaaacccacactgggactgattgatcctctgcacaccctccacatgcctgcccgagtggtcgccaacagtggctttgatgtgctttgccatgccctggagtcatacaccaccctgccctaccacctgcggagcccctgcccttcaaatcccatcacacggcctgcgtaccagggcagcaacccaatcagtgacatttgggctatccacgcgctgcggatcgtggctaagtatctgaagagggccgtcaacagcactgacaaatgaagaagaagaatgagtctcagggcaccttcctggagtggccctcgccatccagggaccagcgcgttgcctcccccggcgcttttacatcacatgagcagctgacagcgtatttattatgcctttgctgaaacagttgatgagaaatatgtttcccttcagttttcatttagaagacaaggcgtcgtttgaataacttgcctgatttttcttcctaccgagtagcatttctttttttttcaccatatctttccctaaggcagctccttattctgtaggaattgccaatgttgatgtgttattgttaggtatttatatcattcacagggctgtcagaaatcccgatgatcttgaagcaaggtctcatatgcacttggcaagtgcttttgctggcatcggctttggaaatgctggtgttcatctgtgccatggaatgtcttacccaatttcaggtttagtgaagatgtataaagcaaaggattacaatgtggatcacccactggtgccccatggcctttctgtggtgctcacgtccccagcggtgttcactttcacggcccagatgtttccagagcgacacctggagatggcagaaatactgggagccgacacccgcactgccaggatccaagatgcagggctggtgttggcagacacgctccggaaattcttattcgatctggatgttgatgatggcctagcagctgttggttactccaaagctgatatccccgcactagtgaaaggaacgctgccccaggaaagggtcaccaagcttgcaccccgtccccagtcagaagaggatctggctgctctgtttgaagcttcaatgaaactgtattaattgtcattttaactgaaagaattaccgctggccattgtagtgctgagagcaagagctgatctagctagggctttgtcttttcatctttgtgcataacttacctgttaccagtataggtgggatatacatttatcttgcaggaaattccccaaagctcagagtccagttccttccataaaacaggctggacaaatgaccactatgttagacccccaggctcgacttcaggggtcagtgttcctgtcccaaaccccacacagaatactctgcctctgcttcatgtagcaaatgagcaaaaactcagtatctatcaaaagtgtaaattatatttcctatgcctagtaattcacttcatgtctaaaaatttatctgatagaaacactagcaccagtacatacagaagcatggcaaggatgtttctggcagcacttttctaataataaaagatttgaaacaaaaaaaaaaaaa

SEQ ID NO: 12 - DNA, 2763 bp, Homo sapiens
  CDS (196)..(1338)
gcacgagctaaacctgaagaaagtttagagcctggggctataaactacctgagtctttccaaacgacaagccaagaagacctgttgaaagtttcctcttaagtttcgtggagagagactcaggtatagaaatatccttactgccacctgacctgaagcagaagaaatcacagacagcttccagaccaggcccaacatgtgtagcaccagtgggtgtgacctggaagaaatccccctagatgatgatgacctaaacaccatagaattcaaaatcctcgcctactacaccagacatcatgtcttcaagagcacccctgctctcttctcaccaaagctgctgagaacaagaagtttgtcccagaggggcctggggaattgttcagcaaatgagtcatggacagaggtgtcatggccttgcagaaattcccaatccagtgagaaggccataaaccttggcaagaaaaagtcttcttggaaagcattctttggagtagtggagaaggaagattcgcagagcacgcctgccaaggtctctgctcagggtcaaaggacgttggaataccaagattcgcacagccagcagtggtccaggtgtctttctaacgtggagcagtgcttggagcatgaagtgctgtacaaagcccagaagtgccctaggagtttgagcacaccaaccttctgtccaaaacgccactccattactgtcttcaagtcctgtgaattacctaatgttagtcttcaaatgttacatgctgtggaccccaaagtcatttccattgccaaccgagtagctgaaattgtttactcctggccaccaccacaagcgacccaggcaggaggcttcaagtccaaagagatttttgtaactgagggtctctccttccagctccaaggccacgtgcctgtagcttcaagttctaagaaagatgaagaagaacaaatactagccaaaattgttgagctgctgaaatattcaggagatcagttggaaagaaagctgaagaaagataaggctttgatgggccacttccaggatgggctgtcctactctgttttcaagaccatcacagaccaggtcctaatgggtgtggaccccaggggagaatcagaggtcaaagctcagggctttaaggctgcccttgtaatagacgtcacggccaagctcacagctattgacaaccacccgatgaacagggtcctgggctttggcaccaagtacctgaaagagaacttctcgccatggatccagcagcacggtggatgggtaagcgtatcctatttacaaattttctcagaactcagaagagatgggatggattttttttttttttttaaatgaagggaacacatctatgaagcagttctcatgagtttaggacacttgagtggccagagatagatcccattgatgggaacatatttttagtgattatcttcatcatcaataaatatttactgagctctccaagggtatgcagggtatgtgtggatggaaagggactggtcagatggaacaggaaatgaggagatgctgagataagaaatgtttagatgagacgtaatttctgttttcacaaattttgcaggcaacggaagtctggcagggagacaagggcaggcagacagttcctcacacttgcagatacttagaggtcacggagactaagcctcatgcagagactcagggttcatggcattttgtcattgctgctgtgacccagccattttgagggtgacattttgataccaaataaaaagccgacagttaaactttcatctattttcaattacctggtatcagtctaaacagacctctgtcccttttgcctcaaaccctctcccatccctcatccccagttcctcaggtctccttaagactgccatgttcaaacagctacataaggtccaccgtgtcaaaatgtactaccccacaactttaactctcaacaggcctaggcattcctaggcggacagaccttcatcccacattatccttagttctctttccactagaatggtccaggggccagcaggaggattgagtcggctctaggcatggctggagtgaccctgggacctccacacagccttggtctctttgctgatggaaggaaagtgcagctgatcttgcccaagggtctgaagtgcccgccatggtcttcagtggctgccacggtcttcagtttctgtacattgagttcctttctattttccacttttgcaccaagtttgataaccctaagtggctgatctgaacaaccaaggccattcttaagtattctaaacttaagctgccttagcttattctaaaaggaggacaggttcctcaacattattttagttctacctattcttctttccaggattccttcaccccaacaacccccttgagccctcatctgccccaaagcctctcctgacccttccagctcaaaggctgcacagtctctaatctccagcacttcatgtttgcaccataataatatacaaaagatgatcaaattcccaattgactatgtttcaagcattcattttaaaaatcattgttagtcctcttaatatattttctcagagaaattataattatcaattgggttcacaggctagctctcaaaaatctgtttaacccactaatgtagctaaaataccataaatatgctattaaaaagcagtggttctacaccaaaagcacaagcaacaaaagaaagaatagatacattggattttgttttgtgcttccaagaacaccaccaccaagaatgtg

SEQ ID NO: 13 - DNA, 998 bp, Homo sapiens
  CDS (94)..(987)
tgtcgttgttctgaggaagaatcctccaataatctaacccagttccagactgtagaggcccaattgaaacagtggcttgtggaaaaagaacttatggtcagtgttcttgggcccttgtcaattgacccaaatatgctaaacacacaaaggcagcaggtgcagattttgctgcaagaattcgccactcggaaacctcaatatgaacagctgacagcagctggtcagggcattctgagcaggcctggagaagacccttctttacatgggattgtgaaagagcaactggcagctgtgacccaaaaatgggatagcctaacagggcaattgagtgacagatgtgactggattgaccaagccattgttaaaagcacacagtatcaaagcctgctgagaagcctttctgataaactgagtgacttggataataaactcagcagcagtctggctgtgagcacgcaccctgatgctatgaaccaacagttggaaacagcccaaaaaatgaagcaggagatacagcaggaaaagaagcagataaaagtggcccaggcactctgtgaggatttgtcagcactggttaaagaagagtacttgaaagcagaacttagtaggcaactagaaggcatcttaaaatcatttaaggatgttgaacagaaagcagagaatcatgtccagcaccttcagtcggcctgtgcaagctctcatcaatttcagcaaatgtctagagattttcaggcttggctggatacaaagaaagaagagcaaaacaaatctcatccaatatctgccaaactcgatgtcttggagtcattaattaaagatcataaagactttagtaaaactttgaccgctcagtctcatatgtatgaaaaaaccattgcagaaggtgaaaatctgttattaaaaacacaagggtctgagaaggcagccttacagttacagcttaatacaattaaaaccaattgggatacatttaataagcaggtgtgaaaaaaaaaaaa

SEQ ID NO: 14 - DNA, 594 bp, Homo sapiens
  CDS (1)..(531)
atgaaggccttgggcacacaacaagagtacaaggtggtgtgtcactgcctgcccacccccaaatgccacacactgcccctctaccacatgcaaatctttgcgcctaatcatgtagtcgccaagttccacttctggtacttcctatctcaattaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgctcaaataaactcaggaacgccccggtgaaaaaaaaaaa

SEQ ID NO: 15 - DNA, 880 bp, Homo sapiens
  CDS (1)..(555)
atgagtaaagctgtaagaaaaacagtggagccgaaacgactccccaacttaactccccataagctcattgaggacacagactttgttctcttcaccactgtttccccagcacttcgaacactacctggcacttgtatcagttctccctttccaacttggacgcggcagaacggctcctgcaaagaagggtggcgagaagcaaagggtcattctgccatcaatgaggtggtgatccaagaatacaccatcaacattcacaagcgcatccatggagtgcgcttcaagaagcgtgcccctcgggcactcagagagattccgaaatttgccatcaaagaggtggaaactctaagtgtgcgcattgatagcaggttcaacaaagctctctgcgccaaaggaataaggaatgtcccgtaccgaatccgtgtgcagttgtccagaaaacgtaatgaggatgaagattcaccaaataagctatatactttggttacctatgtacctgttaccactttcaaaatttctgtgctaaacagtgttacagtcgccaagagcccataaagggagccctcctggaagtggatgaggccttgggtctcggctcttcattgcttcctgagctgcagcagatgcctttacaaccaagctcaccgaggacgtctgtctcccatattaccctggcagagggccaggcctgttctacacggccggggtttcaacaaggtactgatgtcttctgcccttgcctcttcgacaggcaagtaataagacttaagtgaagagaattctttaggcacacaaattcacatttgatgtaatctcattatacttcctgatctgtgattgaaaactttcatttcgtaactagtatgtctgtcccaccttt

SEQ ID NO: 16 - DNA, 6014 bp, Homo sapiens
  CDS (73)..(3837)
tctcatgcgtttcccccccctcgcggcgctcgcccgctctccctcgctctcgctctgtcttttttgggcgccatgctgaggggaagggaagatggagagttggaagaaggcgaattggaagatgatggggcagaggagacccaggatacctccggagggcctgagagaagccggaaagaaaagggggagaagcatcacagtgattcggatgaggagaagtcccacaggagactgaagcggaaacggaagaaagagcgggagaaagagaaaaggaggtcgaagaagaggaggaaatccaagcacaaacgccatgcttcttctagcgatgacttctctgacttctcagatgactcggatttcagccccagtgagaaaggtcaccgcaagtacagagagtacagccccccatatgcgccgtcccaccagcagtaccccccatcgcatgccacgcccctgcccaagaaggcatactccaagatggacagcaagagttatggcatgtacgaggactacgagaatgagcagtatggggaatatgagggcgacgaggaggaggacatgggcaaggaggactatgacgacttcaccaaagagctgaaccagtaccggcgtgccaaggagggcagcagccgcggccgaggcagccgaggccggggccggggctacaggggccgaggaagccgtggaggatcgcgaggccgcggcatgggcaggggcagccgaggcaggggcagaggctctatgggaggagaccacccggaggatgaagaggatttctacgaggaagagatggactatggagagagtgaggagccaatgggagacgacgactatgacgagtactccaaggagctgaaccagtaccgccgctccaaggacagccgaggccgagggctaagtcgaggccgtggcaggggctcccgaggtcgagggaaaggaatgggtcggggccgaggccgaggtggcagccgaggagggatgaacaagggcggaatgaacgatgacgaagacttctatgacgaggacatgggcgacggtggtggtggaagctaccggagtcgtgaccatgacaagccccaccagcagtcggacaagaaaggcaaagtcatttgcaagtacttcgtggaagggcgctgcacctggggagaccactgtaattttagccatgacatcgaactgccaaagaagcgagaactgtgcaagttttacatcactggattttgcgccagagctgagaactgcccttatatgcacggtgatttcccgtgtaagctgtaccacaccactgggaactgcatcaatggtgacgactgcatgttttcccacgaccctctgaccgaagagacgagggagctcttggataagatgttggccgatgatgcagaagcaggtgccgaggatgagaaggaggtggaggaactgaagaagcagggcatcaaccccctgcccaaaccgccccctggtgtgggcctcctgcccacccctcctcggccccctggcccgcaggctccaacctctcccaacggcaggcccatgcagggtggccccccgcccccgccccctccccctcccccaccgcccgggccccctcagatgcccatgccggtgcatgagccactgtccccgcagcagctgcagcagcaggacatgtacaacaagaagatcccctccttgtttgagatcgtggtgcggcccacgggacagctggctgagaagctgggtgtgaggttccctggacctggtggacccccagggccaatgggccctgggcccaacatgggacccccagggccaatgggcggtccaatgcatcctgacatgcaccccgacatgcacccggacatgcaccctgacatgcacgcagacatgcacgcagacatgccgatgggccctggcatgaatcctggcccacccatgggccctggcggccctccaatgatgccctacggccctggagactccccacattctggaatgatgccccctatcccgccagcccagaacttctatgaaaacttctaccagcagcaggagggcatggagatggagcccggactcctgggggatgcagaggactacgggcactacgaagagctgccaggggagcctggggagcacctcttccctgagcaccctctggagcccgacagcttctctgagggagggcccccaggccggccgaagccaggcgccggtgtccctgacttcctgccctcagcccagagggccctgtacctgaggatccagcagaagcagcaggaggaggaggagagagcgaggaggctggctgagagcagcaagcaggaccgggagaatgaggaaggtgacaccggaaactggtactcaagtgatgaggatgagggtggaagcagtgtcacctccatcctgaagaccttgaggcagcagacgtccagccgacccccggcttcagttggggagctgagcagcagtgggctgggggacccccgcctccagaagggacaccccacaggaagccggctggctgaccctcgcctcagccgggaccccagactcacccgccatgtggaggcttctggcgggtctggcccaggtgattcgggaccctccgatcctcggctggctcgcgccctgcccacctccaagcccgaaggcagccttcattccagccctgtgggccccagcagttccaaggggtctgggccgcccccaacggaggaggaggaaggggagcgggccctgcgggagaaggccgtgaacattcccctggacccactccccgggcaccctctgcgggacccacggtcacagctgcagcagttcagccacatcaagaaggacgtgaccctgagcaagcccagcttcgcccgcaccgtgctctggaatcccgaggacctgatccccctacccatccccaagcaggacgcagtgccccccgtgcccgcggccctgcaatccatgcccaccctggacccccggctgcaccgcgctgccacggcagggccccccaacgcccggcagcgcccgggcgcctccacggattccagcacacagggcgccaacctccccgactttgaacttctgtctcgcatcctcaagacagtcaatgccaccggctcctcggccgcccccggttccagcgacaaacccagtgacccccgggtgcggaaggcccccaccgaccctcggctgcagaaacccacagactctacggcctcctcccgggctgccaagcccggccctgctgaggcgccctctcccaccgccagcccgagtggggatgcctccccaccagccaccgctccctacgacccccgcgtgctggcggccggtggactgggccagggcggagggggcgggcagagcagtgtgctgagcggtatcagcctctacgacccgaggactcccaacgcggggggcaaagccacagagccggctgctgacacgggtgcccagcccaagggtgctgagggcaatggcaagagctcggcctccaaggctaaggagcccccgttcgtccgcaagtctgccctggaacagccagagacagggaaggccggtgctgatgggggcacccccacggacagatacaacagctacaaccggccccggcccaaggctgctgcagcccccgctgccaccaccgccaccccaccccccgagggtgccccaccccagcccggggtgcacaacctgcccgtgcccaccctcttcgggacggtgaagcagacacccaagacgggctcaggaagcccatttgctgggaacagtccggcccgcgagggtgagcaggatgcggcatccctgaaggatgtttttaaaggcttcgaccccacggcctcccccttttgccagtagtgtccagccagagctgcggctccagccacccttcctagggtggcattcagggcagcacccagggtagggaacttgggggcaaggggaggcaggctgggtgttccttttttcttttctttttcttttgctttccgtctcttttatttttttttaaagtagtactttctttgagatttgtaaattgtatataaccatcttaagttctggtcagtgtggcgggctcaggggctcctgctgagcaaaccgactcatgcccgcaaacctgtgaactttcgccagtgcctggcctcagactctgtgggctctgcgtggccgggccttgctggaggcccagtgggttttctgggcaaagcatggccccttttccccaggacaaagggaacagttggtgtctgggaaggtattgaacgctcctcaccctgtgcccgaagagacccggaaccaagaccatggcagggcctgcgtggaagcaggtccaggcgtttctagaaccctagggtgcaccatcactgtcttttcagtgcaggctgtaacaacccactcaggagacagtgagagtgaaaaggtattaaggaaaaagcccccagcggcactatgggggctccctggtgcatgcctgctcctgtccctggattaccacacgtgccctccctgccaccctccgtctagagcaagcggatgccccccagcctgcagcagaagcctccacagtgagaactggacccaaaggtagtgggggccggtgtggggcagagtcctgaagagccacctctaggaggcagcccctaggagcacgcacgttctgtcagtattaccccacctgtcctatcaggtgggccacaccctgcttgcccacaccagggtctgtcctggtcctcaagccacgcacccgctatgcctgcactgcagcccagccccggacagctccaggatccgtgcagtggctgcgccgccaggccccaacaatggggaccctggggtggctcctggccaagtgttctctgttttcctcgcacctccttacactgtgtgacctgcagggcatgaggtattgatgtgttcgggtttcctttcccaagccagcagatgcaggtgttccaaggtgtgttgctctgtgggatttgtggacacttaagaaacggactgagtgggaaccctgcagccaggggatggggagcctctgctccccccatgctcccaccctggctgagggccagcctcatctgcagagccctggaggaggcccacctatggacacagcccgagagatgggcgcaaggggtgctgggggaggcctgctatcctgcctctgggccacttgaggggcctcaggaagtgtgtgcttgtggctgcatctgcccgtctccctggcccaccatgtggctgcaggccaagctcttcattgctgaccatgaagagacctagttacctgccaagggattccccttccctcctcctcagggtggggtgaacaaggctcctatcccaccccaccccaaaaagagaaaaatgaaaaactcatagtttggagccaggaggcagggtgtcctacagggctgcacagccctgaggggtcagtgctgggatctggttggttggtttgtctttttgtctttttttttttttttttttttttacacaatcattaatgagatttgtcttcagccaccagtgttggccttgaagcagagggcacagcccttggtgtttgtaaaataagtatgaatacacagtgtggcagtgttgtggtttttgttgttgtttttcctctccttttgagaattttcttttgtaaaagaaaaatattttttaaaccgaaatctgtggatgaaatagaagctggagccctcctcttggaatattcagcctaagaacctcataggactatgaattcacccgaaattctcatttgccatcaggccgagcttttaaagaaaaattgttctctaaccaggattgtaacaaaagtgtaaatactgtttcagagttgagagttggtggtgcaaatatgtatataatgaactgtatttttacaatgatcgccgcatgactatttcacaccctttttatactccatatctgtcttccagaaacgtcacctgcctttctcctgtggtctcttaatccagtaattgtattactgccattaaaggatgcagttattttaaaaaaaaaaa

SEQ ID NO: 17 - DNA, 1652 bp, Homo sapiens
  CDS (23)..(1495)
tttcgtcctgacagtctctgagatgacaatagggagaatggagaacgtggaggtcttcaccgctgagggcaaaggaaggggtctgaaggccaccaaggagttctgggctgcagatatcatctttgctgagcgggcttattccgcagtggtttttgacagccttgttaattttgtgtgccacacctgcttcaagaggcaggagaagctccatcgctgtgggcagtgcaagtttgcccattactgcgaccgcacctgccagaaggatgcttggctgaaccacaagaatgaatgttcggccatcaagagatatgggaaggtgcccaatgagaacatcaggctggcggcgcgcatcatgtggagggtggagagagaaggcaccgggctcacggagggctgcctggtgtccgtggacgacttgcagaaccacgtggagcactttggggaggaggagcagaaggacctgcgggtggacgtggacacattcttgcagtactggccgccgcagagccagcagttcagcatgcagtacatctcgcacatcttcggagtgattaactgcaacggttttactctcagtgatcagagaggcctgcaggccgtgggcgtaggcatcttccccaacctgggcctggtgaaccatgactgttggcccaactgtactgtcatatttaacaatggcaatcatgaggcagtgaaatccatgtttcatacccagatgagaattgagctccgggccctaggcaagatctcagaaggagaggagctgactgtgtcctatattgacttcctcaacgttagtgaagaacgcaagaggcagctgaagaagcagtactactttgactgcacatgtgaacactgccagaaaaaactgaaggatgacctcttcctgggggtgaaagacaaccccaagccctctcaggaagtggtgaaggagatgatacaattctccaaggatacattggaaaagatagacaaggctcgttccgagggtttgtatcatgaggttgtgaaattatgccgggagtgcctggagaagcaggagccagtgtttgctgacaccaacatctacatgctgcggatgctgagcattgtttcggaggtcctttcctacctccaggcctttgaggaggcctcgttctatgccaggaggatggtggacggctatatgaagctctaccaccccaacaatgcccaactgggcatggccgtgatgcgggcagggctgaccaactggcacgctggtaacattgaggtggggcacgggatgatctgcaaagcctatgccattctcctggtgacacacggaccctcccaccccatcactaaggacttagaggccatgcgggtgcagacggagatggagctacgcatgttccgccagaacgaattcatgtactacaagatgcgcgaggctgccctgaacaaccagcccatgcaggtcatggccgagcccagcaatgagccatccccagctctgttccacaagaagcaatgaggactgcccagtggaggaggggcgatgtggctggggagctagggagagactctggaggtggtgggtctctggggagacccctaatgaggaagttgaggtaatgcttaacattgttgctgtgagaatttactgccctgtgtttcccagagccattttg

SEQ ID NO: 18 - DNA, 2466 bp, Homo sapiens
  CDS (289)..(1836)
atgactggtcctgcggataagggtgtgcgcgagagccaatcaaaagcggatgtcgaaaagaggcgccgctccagccagtcacgtcgcgaggtgcggtcggggccggctgacgcgactgcgggcctcagccaatgggcgtgccactgcccgtccgctcttcagcagccggtcgcgggcggtggaaaagcgagtgaagagagcgcgacggcggcggcggcggcggcgcagcagctattgctggacggccagtgggagagcgaggcctgagcctctgcgtctaggatcaaaatggtttcaatcccagaatactatgaaggcaagaacgtcctcctcacaggagctaccggttttctagggaaggtgcttctggaaaagttgctgaggtcttgtcctaaggtgaattcagtatatgttttggtgaggcagaaagctggacagacaccacaagagcgagtggaagaagtccttagtggcaagctttttgacagattgagagatgaaaatccagattttagagagaaaattatagcaatcaacagcgaactcacccaacctaaactggctctcagtgaagaagataaagaggtgatcatagattctaccaatattatattccactgtgcagctacagtaaggtttaatgaaaatttaagagatgctgttcagttaaatgtgattgcaacgcgacagcttattctccttgcacaacaaatgaagaatctggaagtgttcatgcatgtatcaacagcatatgcctactgtaatcgcaagcatattgatgaagtagtctatccaccacctgtggatcccaagaagctgattgattctttagagtggatggatgatggcctagtaaatgatatcacgccaaaattgataggagacagacctaatacatacatatacacaaaagcattggcagaatatgttgtacaacaagaaggagcaaaactaaatgtggcaattgtaaggccatcgattgttggtgccagttggaaagaaccttttccaggatggattgataactttaatggaccaagtggtctctttattgcggcagggaaaggaattcttcgaacaatacgtgcctccaacaatgcccttgcagatcttgttcctgtagatgtagttgtcaacatgagtcttgcggcagcctggtattccggagttaatagaccaagaaacatcatggtgtataattgtacaacaggcagcactaatcctttccactggggtgaagttgagtaccatgtaatttccactttcaagaggaatcctctcgaacaggccttcagacggcccaatgtaaatctaacctccaatcatcttttatatcattactggattgctgtaagccataaggccccagcattcctgtatgatatctacctcaggatgactggaagaagcccaaggatgatgaaaacaataactcgtcttcacaaagctatggtgtttcttgaatatttcacaagtaattcttgggtttggaatactgagaatgtcaatatgttaatgaatcaactaaaccctgaagataaaaagaccttcaatattgatgtacggcagttacattgggcagaatatatagagaactactgcttgggaactaagaagtacgtattgaatgaagaaatgtctggcctccctgcagccagaaaacatctgaacaagttgcggaatatacgttatggttttaatactatccttgtgatcctcatctggcgcatttttattgcaagatcacaaatggcaagaaatatctggtactttgtggttagtctgtgttacaagtttttgtcatacttccgagcatccagcactatgagatactgaagaccaaggattcagcattagaacatctatacatatggtgatctaaatgtacaaaatgtaaaatgtataagtcatctcactttttgtcaagacattaaaccatcttagatcggagtgtgaagtaaattatggtatattttatgtaacattttaatgtttatgctcataaaacttagtgaacacactgtgttatgccagctcaaatctacagtagccaccaaaaccatgacttaatattttgagccctagaagaaaggggtgtgctgaggacaagagtggggaaataggaacactgaccagtataactgtgcaattctggaacatattaattaaaataatatgccttaacatatagtgaatttctaattctaatgttcagtgcaatggaagacatttatttggacagtaatactagcaaagttggtagatatttgattcttcattttttgtttttttcattagttgaagtgggttttagttttgtttaaaattataaccagcgtattttcacatcattctgtaagttaaatgatatcaaacatgaaagagatgttctcatttttgtttttctgattaaacgtctgatgcatatcatttttgtataagtaatcagttgcttttaaaatcaga

SEQ ID NO: 19 - DNA, 4808 bp, Homo sapiens
  CDS (818)..(2359)
tttcgtcgcggctggacgctcgccttggctgggggtgtgggggggcacgccgggggccaaggaggactgtcgaggaggagtgatgagaagagggggtgccctgcaccccccgagaccacgggccacgctgtcacttgccaggcgccccccttcctcccaggcgaggggcaggtgttccacactgattctcgtgactttaaggaccagggatttgaagaggtattagctcttcccaggaagggaggaagtttctggaagagaagggaaagacggcagacgctgcgctgggaccagcacagcctgaggagctgtgggaagctgacagagcccagccaaaggagcgggaaggagccgcagccccaggctggcactgtgttctgaaagatttgaactcaagctgctttttacggaagaggggccacttcagagggcaccccagaatttggttgagctcttctactctggatgccccctgctctgaggagcctgccactgagaaccaaagaagataagaggacagatactttttcttcaagcacagagctggtgggttggagtcaggcatctgcacccctagtggctgtctggtgaggaatttcttgtttcttcccagcttgcggcttcagtgcttgatggggctgcctgttggtggatcagtttttgcagtgcctggtaagagtggagagccgtgggaagaggtcctgcggcgcccaagcctgggttcaccccaagactaagttctttcccaagttagagaagaagagagaaagcaaaaagaagagaggaaagttctcccttcccctcctccgtgcctgtcatgtcctctaagccagagccgaaggacgtccaccaactgaacgggactggcccttctgcctctccctgctcttcagatggcccagggagagagcccttggctgggacctcagagttcctggggcctgatggggctggggtagaggtggtgattgagtctcgggccaacgccaagggggttcgggaggaggacgccctgctggagaacgggagccagagcaacgaaagtgacgacgtcagcacagaccgtggccctgcgccaccttccccgctcaaggagacctccttttccatcgggctgcaagtactgtttccattcctcctggcaggctttgggaccgtggctgctggcatggtgttggacatcgtgcagcactgggaagtcttccagaaggtgacagaggtcttcatcctagtgcctgcgctgctggggctcaaagggaacctggaaatgaccctggcatcaaggctttccactgcagccaacattggacacatggacacacccaaggagctctggcggatgatcactgggaacatggccctcatccaggtgcaggccacggtggtgggcttcctggcgtccatcgcagccgtcgtctttggctggatccctgatggccacttcagtattccgcacgccttcctgctctgtgctagcagcgtggccacagccttcattgcctccctggtactgggtatgatcatgattggagtcatcattggctctcgcaagattgggatcaacccagacaacgtggccacacccattgctgccagcctgggcgacctcatcaccttggcgctgctctcaggcatcagctggggactctacctggaactgaatcactggcgatacatctacccactggtgtgtgctttctttgtggccctgctgcctgtctgggtggtgctggcccgacgaagtccagccacaagggaggtgttgtactcgggctgggagcctgttatcattgccatggccatcagcagtgtgggaggcctcatcttggacaagactgtctcagaccccaactttgctgggatggctgtcttcacgcctgtgattaatggtgttgggggcaatctggtggcagtgcaggccagccgcatctccaccttcctgcacatgaatggaatgcccggagagaactctgagcaagctcctcgccgctgtcccagtccttgtaccaccttcttcagccctgatgtgaattctcgctcagcccgggtcctcttcctcctcgtggtcccaggacacctggtgttcctctacaccatcagctgtatgcagggcgggcacaccaccctcacactcatcttcatcatcttctatatgacagctgcactgctccaggtgctgattctcctgtacatcgcagactggatggtgcactggatgtggggccggggcctggacccggacaacttctccatcccatacttgactgctctgggggacctgcttggcactgggctcctagcactcagcttccatgttctctggctcataggggaccgagacacggatgtcggggactagcttggtcactcaacattttccccatccctctgcactttctatttgaaatttttcttttgttcccctgtccctcctccaccccacactcccacctctttctaggacttcactttgataccaaattctcattattttcaatgggaatttttatacattgagccaagtttgtatagcaagaatttgggaaacacagatggcctgagataagcagtacaagtaggtttttgagacaatcaccaagtgcagtttcatggtgggtgcctccaggtgatgtggactggagcaggggagttttgtctggaatctggggacatggggtttggctttagcaacctgtcttggccctaatgagaaaccctttgtaagtgggctctggatttttggttttgttttctttttatctgttttgttttatttttggttttggttgaacagagggacagaagaataagtaacactcccaaacacagacatacttttgtagaagtggaccaacttcaaagctctggacaggagacacctgctccaggcccctgtgatcccagttctgttctcttgccctctggacctaagcgttcccactcgcagaaagagtaaggtggactgacttttcaatttgtgcacatgcctcttgttcaatggcctggtcaacatcaacaacccctccctctgatcatttccagttgattgtcatatccaggaaaaaatggaacagtgcactcttctccctgttgacccatgtccacctattggttccccaaaatccacattctccctgggcccagatgactttgtctccctgggcccagattctttgtctctcttcaaccttcatctcaaattgtctctaagcactaccttccccagagcttgccaggttgggttttgagattagggtcaggtcatgggtatgtggagaatggtttggaggttgaggacaaccacaggtgtctcattgctgccatttctcctgaggacataatcacttggtcaccttggaccctgtcacttcctaaaattactcgttctgtcatgccatagaggtcagttttcctctttcttggcttctacccacaaacattcaccaatcatttattcgttcatttagcaaatatgcagcctccgcaagatgagctctcctgcagacaagcatggtctgaaacattctttgagcaatatcatattgagtgcctactatgtgttaggtactgtgccaggaactgataagccagtggtaagggaaacacagctctaacctcacctcattctccaggttacaaaggccatgtgcccctttgaatctggcagagaaagtttcctcgttgtaagtatttgcatctacttcaagccagattcttctgcctctttctcctttccagacccctactctgtgcagtgctgaccacagctagagccaccgccccattgctcaaccagtatttatttccctaaacgacccttcctcacattcccttccctccacctctccttaccaagcacccaaaagaggatttagaactagcagggtggacatcatctggttgtttctacttttctctgcctagcacaaaattgggagaaaactggagcctccatccgcagtcacacgtgtacagatctggggatttggatgtaggctttttctaacttctctctcagaagcttctacagaaacccttccatctgtagcctcaagggcccacctccaagggaaggcttaggcaatgatcctgtttctaccaacactgcaccttatcccaggaacctgccctagacctccagagaccatattttctctccctccatttctacccagacctccaggcctccttctggaatcatagaaccgtagaattggaaggaattttagaggttttctagttggagttgtgtccaacagaattcattaacaccagcctgggcttgtttttcctcctccctctggacttttttcatcttttcctccacctcaaaaaatacttacacacagattcttcttgtacaggcatcaaaaccaactcctctgcccctaaggctgtgtccctgtggtctccagccacccctaccccagtcactcgccccttcctcatctctggaatttggccaggcagtcccagaagactctggagtgacctcctttgcctaaaaagcagacagataggcatgccccaggccctgagtgagcagaggaggactgtagggtgagagggaaagaaaatgaaggtgactttcatggaagtttcatttcttttccccgattgtaccaactgcatgtacttttggcctggctgcaaggagcaatattggtttactctcgtatccttaaaaagttacagaactgtgtcttaagagaattatttatagttactataactgaattgacaaatgtcaacttaactgataaattatatttggtaaaataaagaggacgtttatttaaaaaaaaaaa

SEQ ID NO: 20 - DNA, 5207 bp, Homo sapiens
  CDS (146)..(4642)
caggcaaggcttatctggtgaaaacttttttgctatgctcagagggtaccgagtagaaaattatgacccaaaagggaccattgctttgtggtcataattttctactcggtaccctctgagcatagcaaattatgaccacaaagcaatggtcccttttgggttccctgaatttttccgctgtgaccctgcaatctctccgagccttcatgcagcagcacagatttctaggggagaatttgtccgcatctcaggattagattatgtggacagtgccctcctgatggggagagacagggacaagcctttcaaacggaggttgaaatcagagtcggtggaaacatctctcttccgaaagcttcgaactgttaaaagtgagcacgaaactttcaagttcacgtctgagctggaggagagccgactggagaggggcattcgcccttggaattgtcagcgatgttttgcacattatgatgtccagagcattttgtttaatatcaacgaagccatggctacgagggctaatgtggggaaaaggaaaaacataaccactggggcatctgcagcatcccagactcagatgcctacgggccagacaggcaactgtgagtcccctttagggagcaaggaggacctcaactccaaagagaacctggatgccgatgagggtgatgggaaaagtaacgacctcgtccttagttgtccttactttagaaatgagactggaggggaaggcgacaggcggattgcgctctctcgagccaactcatcctctttcagttctggggaaagctgctctttcgaatcgtcactcagctctcactgcacaaatgcaggtgtctccgtcttggaagtgcccagagaaaaccagcctattcacagggagaaagtgaagcgctacatcatagaacacattgaccttggggcctattattaccgcaaattcttctatgggaaagagcaccaaaactactttggaatagatgaaaaccttggtccagtagcagtcagcatccggagagagaaggtggaagatgccaaggagaaagaaggatcccagttcaactacagggtggctttcaggacaagtgagcttacaacactgagaggagcaattttagaagatgctataccctctactgctaggcatggtaccgcacgaggactacctctcaaagaagttttggaatacgtcattccagagctgagcattcagtgtttgcgacaggcttccaactcacccaaggtctcagagcagctgctcaagcttgatgaacaagggctgagctttcagcacaagatcgggatcctttattgcaaagcaggccagagcacagaggaagagatgtataacaatgagacggcgggaccagcttttgaagaattccttgatcttctgggccagagagtccgactgaaaggatttagtaaatatcgagctcagctagacaataagactgattccacgggcacgcactctctctataccacatacaaagactacgaactcatgttccacgtgtcaaccctgcttccctacatgcccaacaacagacaacagctactgaggaaaaggcacataggaaatgacatcgtcaccatcgtcttccaggagcctggggcacttccttttactccaaaaagcatccggtctcactttcagcatgtctttgtcatagtcaaagtgcataatccatgtaccgaaaatgtgtgttatagtgttggagtttccagatcaaaagatgtgccaccatttggcccaccgattcccaaaggtgtaacttttccaaagtcagccgtgttccgggacttccttttagccaaagtaatcaatgcagaaaatgcagcccataaatcagaaaagtttcgagcaatggccactcgaacgaggcaggagtacttgaaagatctggcggagaactttgtcacaaccgccaccgtggatacctctgtgaagttcagcttcattacgctgggtgcgaagaaaaaggagaaggtaaagccaaggaaggatgcccacttgtttagcattggggccatcatgtggcacgtgatagcccgggacttcggccagtctgctgacattgaatgtcttctcgggatctccaatgagttcatcatgttgattgaaaaggattccaagaatgttgtattcaactgttcctgcagggatgtgattgggtggacatctggattagtgagtatcaaagtgttttacgaaagaggagaatgtgtcctcctgtcctcggtagacaactgtgctgaagacatcagggaaattgttcagcgattagtaatagtgacgagaggctgcgagactgtggaaatgaccctgaggaggaacgggctgggccagcttggcttccatgtgaattttgaaggaattgtcgcagatgtggaaccttttggctttgcctggaaggctggccttcgccaagggagccgcctcgtggagatctgcaaagtagccgtggccactctgacccacgagcagatgatcgacctgctccgtacttctgtgactgtgaaggtggtcatcatccagccccatgatgacggctcgccccgaagagggtgttcagagctctgccggatccctatggtggaatataaactcgacagcgagggcaccccctgcgagtataaaacccccttcaggaggaacactacgtggcaccgggtgcccactcctgccctgcagcccctctctagagcttcccccatccccggcacgcccgaccggctgccgtgccaacagctgctccagcaggcccaggctgccattcctcgaagcacctccttcgaccggaagctgcccgatggcacgagaagctcacccagcaaccagtcatcctccagcgaccctggacccggcgggagcggaccctggagaccacaagtgggctacgacgggtgccagtcccctctactgctcgaacaccagggctcaggccctttggaatgtgacggagccagggagagggaagacaccatggaagcaagcaggcacccggaaaccaaatggcatggcccaccttccaaagtcctgggttcctataaagaaagagctctgcagaaagatggaagttgcaaagattcccccaataagctttctcacattggggataaaagttgctccagtcactccagcagcaacacgctctccagcaacacctccagcaacagtgacgacaagcactttgggtctggcgacctgatggaccccgaattactggggctgacctacatcaaaggggcctccaccgacagtgacatcgacacggccccctgcatgcctgccaccatcctcggccctgtgcacctggcaggcagcaggtccctgatccacagccgggccgagcagtgggctgatgctgccgacgtctctgggcctgacgacgagccagccaagttatattctgtgcatggctacgcgtccgccatctccgccggcagtgctgcggaaggcagcatgggcgatctcagtgagatatcctctcattccagtggttctcaccattcaggaagcccttcagctcactgttcaaaaagtagtgggtctctggattcatccaaagtctacatcgtgtctcacagcagcggacaacaggttcccgggtccatgtccaagccctaccacagacaaggggcagtgaacaaatatgtcatcggctggaagaaatcggagggcagcccaccgcccgaggagcctgaagtgactgaatgtcccgggatgtatagtgagatggatgtcatgtccacagcaactcagcatcagacagtggtgggagatgctgttgcagagactcaacatgttctgtctaaagaagattttctgaaattgatgcttcctgacagccccttagtggaggaggggcgaagaaagttttcgttctatgggaacctgtctccaaggaggtcgctttaccgcacgctgtctgacgagagcatctgcagcaacaggagggggtcctcctttggcagttcccggagttccgtgcttgaccaggccctgcccaacgacattctgttcagcaccaccccaccctaccacagcacgctgcctccgcgggcccaccccgcacccagcatggggagcctgagaaatgagttctggttctccgatgggtccttatcagataagtccaagtgcgcagatcctggcctgatgcccctcccggacacagccacagggttagattggacccacctcgtggatgctgcacgggcatttgaaggtcttgactcagatgaagaactggggctgctctgtcaccacacgtcctatctagaccagagggtggcatccttctgcaccctgacagatatgcagcatgggcaggacctggaaggggcccaagagctgcccttatgtgtagatccaggcagtggcaaagagttcatggacacaactggggagcgttctccatcaccactgaccgggaaagtcaatcagctggaattaattcttcgacaactccagaccgaccttcggaaggaaaaacaagacaaggccgttctccaagcagaagtgcagcacctgagacaggacaacatgagactgcaggaggagtcccagaccgcgacagctcagctgcggaaattcacagaatggtttttcaccaccatcgacaaaaaatcttagccaatccgcacctcatcaagggaccactgggaaatgccccttgtccctttgaagtcacaaacatgtggtttttctgtgtgctttcaaccaatcgtagatgtttttgctgttccattctgtgtagcaccattcaccacagcaggatagggagcctcgactctttctcggtaaccacggcagagagcagcgccgatgtgaagatgaatgaatgtaactcctggtgtgaagatgaatgtaaaccctggcgacagttgagacctttttcttttagactctgctaaaacagtgctctggcttgggcttacctcaagagggaagatagttgagttttatttcctgtatatcaggtgacctggtagagatgtaaagcaatttaccatagtttgggctttagtattgtaaaataaacatgagaacaaataatcagacatatactttaatgttaaaggtgctctatttttttggatgtacagtagttttatttccacagccacattaccatagcaataagaaaggaggcatagtacatagttggaaaagctttgtggggggattaaaaaaaaaa

SEQ ID NO: 21 - DNA, 5153 bp, Homo sapiens
  CDS (146)..(4588)
caggcaaggcttatctggtgaaaacttttttgctatgctcagagggtaccgagtagaaaattatgacccaaaagggaccattgctttgtggtcataattttctactcggtaccctctgagcatagcaaattatgaccacaaagcaatggtcccttttgggttccctgaatttttccgctgtgaccctgcaatctctccgagccttcatgcagcagcacagatttctaggggagaatttgtccgcatctcaggattagattatgtggacagtgccctcctgatggggagagacagggacaagcctttcaaacggaggttgaaatcagagtcggtggaaacatctctcttccgaaagcttcgaactgttaaaagtgagcacgaaactttcaagttcacgtctgagctggaggagagccgactggagaggggcattcgcccttggaattgtcagcgatgttttgcacattatgatgtccagagcattttgtttaatatcaacgaagccatggctacgagggctaatgtggggaaaaggaaaaacataaccactggggcatctgcagcatcccagactcagatgcctacgggccagacaggcaactgtgagtcccctttagggagcaaggaggacctcaactccaaagagaacctggatgccgatgagggtgatgggaaaagtaacgacctcgtccttagttgtccttactttagaaatgagactggaggggaaggcgacaggcggattgcgctctctcgagccaactcatcctctttcagttctggggaaagctgctctttcgaatcgtcactcagctctcactgcacaaatgcaggtgtctccgtcttggaagtgcccagagaaaaccagcctattcacagggagaaagtgaagcgctacatcatagaacacattgaccttggggcctattattaccgcaaattcttctatgggaaagagcaccaaaactactttggaatagatgaaaaccttggtccagtagcagtcagcatccggagagagaaggtggaagatgccaaggagaaagaaggatcccagttcaactacagggtggctttcaggacaagtgagcttacaacactgagaggagcaattttagaagatgctataccctctactgctaggcatggtaccgcacgaggactacctctcaaagaagttttggaatacgtcattccagagctgagcattcagtgtttgcgacaggcttccaactcacccaaggtctcagagcagctgctcaagcttgatgaacaagggctgagctttcagcacaagatcgggatcctttattgcaaagcaggccagagcacagaggaagagatgtataacaatgagacggcgggaccagcttttgaagaattccttgatcttctgggccagagagtccgactgaaaggatttagtaaatatcgagctcagctagacaataagactgattccacgggcacgcactctctctataccacatacaaagactacgaactcatgttccacgtgtcaaccctgcttccctacatgcccaacaacagacaacagctactgaggaaaaggcacataggaaatgacatcgtcaccatcgtcttccaggagcctggggcacttccttttactccaaaaagcatccggtctcactttcagcatgtctttgtcatagtcaaagtgcataatccatgtaccgaaaatgtgtgttatagtgttggagtttccagatcaaaagatgtgccaccatttggcccaccgattcccaaaggtgtaacttttccaaagtcagccgtgttccgggacttccttttagccaaagtaatcaatgcagaaaatgcagcccataaatcagaaaagtttcgagcaatggccactcgaacgaggcaggagtacttgaaagatctggcggagaactttgtcacaaccgccaccgtggatacctctgtgaagttcagcttcattacgctgggtgcgaagaaaaaggagaaggtaaagccaaggaaggatgcccacttgtttagcattggggccatcatgtggcacgtgatagcccgggacttcggccagtctgctgacattgaatgtcttctcgggatctccaatgagttcatcatgttgattgaaaaggattccaagaatgttgtattcaactgttcctgcagggatgtgattgggtggacatctggattagtgagtatcaaagtgttttacgaaagaggagaatgtgtcctcctgtcctcggtagacaactgtgctgaagacatcagggaaattgttcagcgattagtaatagtgacgagaggctgcgagactgtggaaatgaccctgaggaggaacgggctgggccagcttggcttccatgtgaattttgaaggaattgtcgcagatgtggaaccttttggctttgcctggaaggctggccttcgccaagggagccgcctcgtggagatctgcaaagtagccgtggccactctgacccacgagcagatgatcgacctgctccgtacttctgtgactgtgaaggtggtcatcatccagccccatgatgacggctcgccccgaagagggtgttcagagctctgccggatccctatggtggaatataaactcgacagcgagggcaccccctgcgagtataaaacccccttcaggaggaacactacgtggcaccgggtgcccactcctgccctgcagcccctctctagagcttcccccatccccggcacgcccgaccggctgccgtgccaacagctgctccagcaggcccaggctgccattcctcgaagcacctccttcgaccggaagctgcccgatggcacgagaagctcacccagcaaccagtcatcctccagcgaccctggacccggcgggagcggaccctggagaccacaagtgggctacgacgggtgccagtcccctctactgctcgaacaccagggctcaggccctttggaatgtgacggagccagggagagggaagacaccatggaagcaagcaggcacccggaaaccaaatggcatggcccaccttccaaagtcctgggttcctataaagaaagagctctgcagaaagatggaagttgcaaagattcccccaataagctttctcacattggggataaaagttgctccagtcactccagcagcaacacgctctccagcaacacctccagcaacagtgacgacaagcactttgggtctggcgacctgatggaccccgaattactggggctgacctacatcaaaggggcctccaccgacagtgacatcgacacggccccctgcatgcctgccaccatcctcggccctgtgcacctggcaggcagcaggtccctgatccacagccgggccgagcagtgggctgatgctgccgacgtctctgggcctgacgacgagccagccaagttatattctgtgcatggctacgcgtccgccatctccgccggcagtgctgcggaaggcagcatgggcgatctcagtgagatatcctctcattccagtggttctcaccattcaggaagcccttcagctcactgttcaaaaagtagtgggtctctggattcatccaaagtctacatcgtgtctcacagcagcggacaacaggttcccgggtccatgtccaagccctaccacagacaaggggcagtgaacaaatatgtcatcggctggaagaaatcggagggcagcccaccgcccgaggagcctgaagtgactgaatgtcccgggatgtatagtgagatggatgtcatgtccacagcaactcagcatcagacagtggtgggagatgctgttgcagagactcaacatgttctgtctaaagaagattttctgaaattgatgcttcctgacagccccttagtggaggaggggcgaagaaagttttcgttctatgggaacctgtctccaaggaggtcgctttaccgcacgctgtctgacgagagcatctgcagcaacaggagggggtcctcctttggcagttcccggagttccgtgcttgaccaggccctgcccaacgacattctgttcagcaccaccccaccctaccacagcacgctgcctccgcgggcccaccccgcacccagcatggggagcctgagaaatgagttctggttctccgatgggtccttatcagataagtccaagtgcgcagatcctggcctgatgcccctcccggacacagccacagggttagattggacccacctcgtggatgctgcacgggcatttgaagaccagagggtggcatccttctgcaccctgacagatatgcagcatgggcaggacctggaaggggcccaagagctgcccttatgtgtagatccaggcagtggcaaagagttcatggacacaactggggagcgttctccatcaccactgaccgggaaagtcaatcagctggaattaattcttcgacaactccagaccgaccttcggaaggaaaaacaagacaaggccgttctccaagcagaagtgcagcacctgagacaggacaacatgagactgcaggaggagtcccagaccgcgacagctcagctgcggaaattcacagaatggtttttcaccaccatcgacaaaaaatcttagccaatccgcacctcatcaagggaccactgggaaatgccccttgtccctttgaagtcacaaacatgtggtttttctgtgtgctttcaaccaatcgtagatgtttttgctgttccattctgtgtagcaccattcaccacagcaggatagggagcctcgactctttctcggtaaccacggcagagagcagcgccgatgtgaagatgaatgaatgtaactcctggtgtgaagatgaatgtaaaccctggcgacagttgagacctttttcttttagactctgctaaaacagtgctctggcttgggcttacctcaagagggaagatagttgagttttatttcctgtatatcaggtgacctggtagagatgtaaagcaatttaccatagtttgggctttagtattgtaaaataaacatgagaacaaataatcagacatatactttaatgttaaaggtgctctatttttttggatgtacagtagttttatttccacagccacattaccatagcaataagaaaggaggcatagtacatagttggaaaagctttgtggggggattaaaaaaaaaa

SEQ ID NO: 22 - DNA, 2244 bp, Homo sapiens
  CDS (187)..(981)
ctggccaaggtatagaaagccttttagtcaaatcattctttggtttggtgagagatataaaggtatacatactgtcattagtgtactgcctaaaaataatatcgattcttttcctctccagaggctggaagtcatccacaacaaacacaaaaattggaagaaattaaagagaatgcacaggacaccatgagacagattaataaaaagggtttttggagctatggccctgtgattcttgtcgtcctggttgtggctgttgtggcaagttctgtgaatagctactattcctctccagcccagcaagtgcccaaaaatccagctttggaggcctttttggcccagtttagccaattggaagataaatttccaggccagagttccttcctgtggcagagaggacggaagtttctccagaagcacctcaatgcttccaaccccactgagccagccaccatcatatttacagcagctcgggagggaagagagaccctgaagtgcctgagccaccatgttgcagatgcctacacctcttcccagaaagtctctcccattcagattgatggggctggaaggacctggcaggacagtgacacggtcaagctgttggttgacctggagctgagctatgggtttgagaatggccagaaggctgctgtggtacaccacttcgaatccttccctgccggctccactttgatcttctataagtattgtgatcatgagaatgctgcctttaaagatgtggccctggtcctgactgttctgctagaggaggaaacattagaagcaagtgtaggcccaagggaaacggaagaaaaagtgagagacttactctgggccaagtttaccaactctgacactcccacctccttcaaccacatggactcagacaaattgagtgggctgtggagccgaatttcacacctggtactgccagtccagccagtgagtagcatagaagaacaggggtgccttttctaaagctaagcacagagttggttacagaaggtatatgtttatgaaaaagtttgtttaaagaccttccatttatatggaaggaggttgataaaatagcttgaggaaatagcctgaaaaacaaagatgagcttattttagaaacaagtttttattttttattccttgtaaaatctttctaatctaagccttgacaaagctaaaaattaacctgactttttttctttggaccaaatcaggtttgaaatatcgatgatatatatgagaattttttttaaattctaaaatatagcaacattgcacaggaagatactcttacttcttagagtaactacagagtgattttttttttttcttgagggagactctgaaaaaccttttcgataatgtttggacttggactaaagcaattagaattatgaagcaatgataacctttaaaaaatttttctatcacatgttgaatattttcaaaccttactttaataatctaaagttacgggattatatcttatattaattttgcagttttgagtagtatgataaaagaaataagaattcaaaccattaagtacctacctaaatactacatgtaaggcactgtgcttttatttcattcagctgaggtataagcagctgtactcaaatgttcttaaaaatgagaaccagtggggaaattgtttataatcattggaaatgaagaaattccaattggctatatctttacttcagcttttcttgaacaatttacagcattgattttcaaactgtgtctactggcacccttcccctttgtatcagagcagttctgcttttaactgttttatatgttggggttctctatgagatttcattggaacaaagagtttcactgatattcgagtttgaaaaccattgattaagtgaaaaaacatcttagaagataggaaatatgtttaaaaaatgaatgtattaaatcttatgagtaggaagatgaaatacaggtttattgtatagatacattatttatgaaggataaagatctatacatgaacagcagaatgtataagctagcatttactagcatgtctctgatgcttttgttcatttctgttaatcgtcatttctgtcccctctgcatggaattttatacttgtctagggtaagagtttgtagactctttcagcagaacagattttaataaccaatttatttgttttattttaaaaatttatttttgaataaccaatttaatagtaaattttatatgaacatttggcaaaaaaaaaaa

SEQ ID NO: 23 - DNA, 1573 bp, Homo sapiens
  CDS (713)..(1441)
tatgaagataatttttaaaacagttttttggattaaagtcccgtattttccaaaatagcacatctcaattggttatatttcgagggttatcaactagctacgttgcaagagctgagtcaactcaggaggccagcggccaccataaggggcaatgcatttagagttcacttattaaatgctgacgttaacagaacccacagagccgcatttcccttggtttcggaggacacgcgaaaaataacaacagcaaagggttctcgagcatctccttcgcgccagacggtgtgttgtactttgtcatcgtcgcagtaaggccggtgctatcgccctcctagtttgaccaagcgagaggactttctccagatgggcccctcccgagagaatggtcgccgtcccgctctcctgttcgggtcaccaccggccgggcgccactcgaacgagccccggccagccgtcaccctaatcattcccgaaggaggggccatcagagctacagctcatcagggtcaatcagaaggggcgcccgcacgcaaaggtcacctgcaaaccgaagcggcgcacggataaggtccgggacttgaagtctatctccaaacattcaggctcctcctccgactcctcctcgaactggcgctcagaggcgccaccattcggaaggagcccaggccacgcgcagctcgccctcccgcaccgcgagggcagcagccgcctcatgcgactcgagaacgctagagggcgccgcttccgggagcccgcaagcggcttccgggtgctcgcgcgccgacctggacgcagagaagccagagactttcgcttccggctgccgcaggcgcttcgctggtgcagacgcagtgctgagcacacagctaccggacaaagagtgacgcccggagctggagttatggcggctacggagccgatcttggcggccactgggagtcccgcggcggtgccaccggagaaactggaaggagccggttcgagctcagcccctgagcgtaactgtgtgggctcctcgctgccagaggcctcaccgcctgcccctgagccttccagtcccaacgccgcggtccctgaagccatccctacgccccgagctgcggcctccgcggccctggagctgcctctcgggcccgcacccgtgagcgtagcgcctcaggccgaagctgaagcgcgctccacaccaggccccgccggctctagactcggtcccgagacgttccgccagcgtttccggcagttccgctaccaggatgcggcgggtccccgggaggctttccggcagctgcgggagctgtcccgccagtggctgcggcctgacatccgcaccaaggagcagatcgtggagatgctggtgcaagagcagctgctcgccatcctgcccgaggcggctcgggcccggcggatccgccgccgcacggatgtgcgcatcactggctgagcggtggagctgcgggcggccagggccgggcgctctgtgcggactggggccatgatcgggcccgggggcctgagcctgggaccccaccccgtgttaatgaaaaatgagttttggcagcgccaaaaaaaaaaa

SEQ ID NO: 24 - DNA, 4213 bp, Homo sapiens
  CDS (36)..(3224)
tgcccattgaaagcaaatttcggaacatctggataatgtccaccccgagccgattcaagaaggacaaagagatcatagccgagtatgaaagtcaagtcaaagaaattcgagctcaactggtagaacaacaaaaatgcctggagcagcaaacggagatgcgagttcagcttctccaggatctgcaagatttcttccgaaaaaaagctgaaattgagacggaatattcccggaatctagagaagttagcagaaaggttcatggcaaaaacaagaagcactaaggatcatcaacaatacaagaaagaccagaacctgttgtctccagtgaactgctggtatttgctcctgaaccaagtaaggagagaaagcaaagaccatgcaaccttgagtgacatctatctgaacaatgtgattatgcggttcatgcagataagtgaggattctaccaggatgtttaaaaagagcaaagagattgcattccaacttcatgaggatttaatgaaggttcttaatgagctttatacggtgatgaaaacataccatatgtatcatgcagagagcatcagtgcagagagcaagctgaaagaggccgaaaaacaagaggaaaagcaaattgggagatctggtgatccagtcttccatattcgactagaggagagacatcaacggcgaagctctgtaaagaaaattgaaaaaaaaaaaaaaaaaagacaagcaaaatattcagaaaataagctaaaatcaattaaggcacggaacgaatatctcctaacacttgaagccaccaatgcctcagttttcaagtactatattcatgatctttctgatttaattgattgctgtgatcttggctaccatgcaagtctgaacagagccctaagaacatatctgtctgcggagtacaaccttgaaacctccagacatgagggcttagacattattgagaatgcagttgataatttagagcccaggagcgataagcagagattcatggagatgtaccctgctgcgttctgtccaccaatgaagtttgagtttcagtctcacatgggtgatgaggtgtgccaggtcagtgcccagcagccagtccaggcagagctcatgctcaggtaccaacagttgcagtcccgccttgccacgctcaaaatcgagaatgaagaggttaagaaaacgactgaagccaccttgcagacgatacaagatatggtcaccatcgaggactatgatgtttctgaatgcttccagcacagtcgttccacagaatctgtgaagtccactgtctctgaaacctacctgagtaaacccagcatcgccaagagaagagccaaccagcaggaaactgaacagttctacttcatgaaactcagagaatatttggaaggcagtaatctcatcacaaaacttcaagccaaacatgacttgctgcagaggaccctgggagaaggtcatagagctgaatatatgactacaagccgaggacgaagaaactcgcacacaagacatcaggactcaggacaggttattcccctcattgtggaaagctgtattcggttcatcaatctctatggtcttcagcatcaggggattttcagagtgtctggttcccaggtggaagtcaatgatattaaaaattcatttgagagaggtgaaaatcctttggctgatgaccagagtaaccatgatattaactcagttgctggcgttctgaagctctatttccgtgggctggaaaaccccctctttcctaaggaaagatttaacgatctgatttcttgtatcagaatagataatctctatgagagggcgcttcacatccgcaaactcctcctgactttgcccaggtcggtccttatagtgatgaggtacctctttgccttcctcaatcatctatcacagtacagcgatgagaatatgatggacccttataacctggccatttgctttggcccaacattgatgcctgtcccagaaatacaggatcaagtgtcttgccaggcacatgtgaatgaaattatcaaaaccatcatcatccaccatgagactattttcccagatgctaaagagctggatggccctgtttatgagaaatgtatggctggagatgactattgcgacagcccatacagtgagcacggtacattggaggaagtggaccaagatgctggtacagagccccacacaagtgaagatgaatgtgagccaatagaagcaatagccaagtttgactatgttgggcggtccgccagagaactatccttcaagaagggtgcctccctgctgctgtatcaccgtgcatctgaggactggtgggaaggcaggcacaacgggattgacgggctggtgcctcaccagtatatagtggtgcaggatatggatgatacgttttcagacactctgagccaaaaagccgacagtgaggccagcagtgggccagtcacggaagacaagtcctcatccaaggacatgaactccccgacagaccgtcatcctgacggctatttagccaggcaacgaaaaagaggagagccaccccctccagtaaggcgtcctggcaggaccagtgatggccattgcccgctccaccctccacatgccctttctaactcctcagttgacctagggtccccaagccttgccagtcacccccggggcctgctgcagaaccgtggcctcaacaatgacagtcctgagcggaggcgcaggcctggccatggcagcctgaccaacatcagccggcacgactccctcaagaagatcgacagccctcccattagaaggtccacgtcatcagggcaatacacgggcttcaatgaccacaagccactggacccagagacaattgctcaggatattgaagaaacgatgaacacagctttgaatgaactccgagaactggagagacagagcacagcaaagcatgcccctgatgtggtgctggataccctggagcaagtgaaaaactctcccacccctgccacttccacggaatctctcagccctttgcacaacgttgccctcaggagctccgagcctcagattcgacgtagcacgagctcctccagtgacacaatgagtactttcaagcctatggtggcacccagaatgggcgtgcagctgaagcctccagcccttaggccaaaacctgctgttcttccaaaaacaaatcctaccataggacctgccccacctccccagggtccaacagacaagtcatgcacaatgtaaaaaccagccaagcaaggccataaagggaggtgacttaaaaaagaaaatggattagtgacaaaagtcactgatccataactttccttagttttgtgcttataactggagatcttttggcttttctatgttgtcgaatgtaatgtctgagactagctaaattaacacgggcatttgtattttgtaatttttttaaataactggacatatgtcattttaaggacaatagaaacacttagacttacttgaaaatccaatgctgcaccacttgtaatgaaggcaacaccgctctccacattgtacagagcttcaggtttaatgtagcccagctgagtcagaaaggttgtgacctgaaggcagaagaacccgaatgccacacctcattggagtatagccagtgttggtctgtggcacttgggctgaaaggtgataatggcattgcgtggtagctgacaatgagcaccttcggttccatgtggagcggggtttagctcatgcaaaagacttgcaattgtctccatgggacgatcccagtgggactgtcagcccacagctcgagtgggttggatgcttgcctctttcctaacagttatttccccgggtccagcttaaagactcgatggaaggaggtagaacctctgctgttactgcttgaacttaacctgggaaaggagaggaagacaccatctccaaagctattaatgtcactccttttgcgagcatgattaggccccggagatttccaagtccccccatctacacttacaaacgattagaagggtttaattttaaagactttctggttacactactccacgaactcctccaaagatccgttattcaataactgcctagaaaatgtttccatctcctctaaatccctgtgttctcctctgtggaaatgaaggcagcaagaagcacctgaggccttggttcatgcagtgttctcttttgactaaatcacctaggttcctttaaacatgctacaaagc

SEQ ID NO: 25 - DNA, 1932 bp, Homo sapiens
  CDS (95)..(1123)
tcacacaagcagaagcaaatgtattcttacagaagcttctgcatcagttctctgtttcgtcttttacccgttttacctgggtacaccgaaccacatgggaccccttaatcaggtgtccttccatgttttccatttcctggtccgtgctgtcgtcctctacattttggatttcatgatagaggcaagacgttgtagaatgaatgaagacactggcactgattatataacaccttggcagctatctcaagtcgttgatggaggaggtattggaattatagaagaaagcaaacacacaaatttgactaaaggcgattttgtgacttctttctattggccctggcaaaccaaggttattctggatggaaatagccttgaaaaggctagcgatatcagtatgacactctctcgagatgctgggcagcggcaacaagctgtagctcctggtcagccaccgtatgtggctgaacaactccgtgaatcatgcccagctggagtggatgtttattttgacaatgaccataagggtaaacaactggtactctacggtgtactgtgttgccagatgattttgcccagccataagtgttctgagcatgttttaggttgttccagagtggtgggaatttgtggaacacatgagaaatgcatcctcttgacctcagaactgggctttgatgctgcaattaattataaaaaagacaatgtggcagaacagctccgtgaatcatgcccagctggagtggatgtttattttgacaatgttggtggtaacatcagtgatacagtgataagtcagatgaatgagaacagccacatcatcctgtgtggtcaaatttctcagtacaacaaagatgtgccttatcctcccccgctatcccctgctatagaggcaatccagaaagaaagaaacatcacaagggaaagatttctggtattaaattataaagacaaatttgagcctggcattctacagctgagtcagtggtttaaagaaggaaagctaaagattaaagagacggtaataaatgggttggaaaacatgggagctgcattccagtccatgatgacaggaggtaacattggaaagcagatagtttgcatttcagaagaaatctctttgtaattgctgtaaatgtcatcaaggcaatcatagatttcttttccattttgcatattttcaaagatatgttaaaaaatccttagactatacatagctcttgatttaaatgtgatcataggtgttatttttagttgcatagggtatttgatacaatcattaatggatcatacacaataggtttttaaaaattaataacttttagtaattacttttattaatttaaaatagaacacttgagaggcactttgtaaagatttgttaaactggaaacgttttacatgatctgatacaaccattaatgaatcatacacaataggttttttaaaattaatattaataacttttattaatttaaaatagaatgcttaaaataaaatagaatgcttgagaggcactgagtaaagatttgttgaactggaaatgttttacatgattcttaaactgaaacttggtgtaaaaatagaattgagatggcctttttttcacattgtagactgaaaagagacttaatggtatgatgtgtacatagggactgggggcaggattgggggtttcggagcttgtgtaacagtttttgggataggagaccagcggttttgggttgggattactatgggaagataaataacttaggttggttaagttgacaagatttactccagaggatcatctctttgtatttgccaaataatttactgtatagcctaaaaactccatatatattgagaaaagcatatgtttattttaggttagcaggcacatactgtcaagttgtaaagattgagagggcaaacagatgtaaacatcacttg

SEQ ID NO: 26 - DNA, 2426 bp, Homo sapiens
  CDS (687)..(2096)
tactatctatcatggaataacatccaagaaagacaccttgcatattctttcagtttctgttttgttctcccacatattctcttcaatgctcaggaagcctgccctgtgcttgagagttcagggccggacacaggctcacaggtctccacattgggtccctgtctctggtgcccacagtgagctccttcttggctgagcaggcatggagactgtaggtttccagatttcctcttcctaggcccacagccagtgcctttggagtactgaggcgcgcacagagtccttagcccggcgcagggcgcgcagcccaggctgagatccgctgcttctgtggaagtgagcatggttgggcagcgggtgctgcttctagtggccttccttctttctggggtcctgctctcagaggctgccaaaatcctgacaatatctacactgggtgagtgcttggccggagaattcccagacaggcgcgtcccggatccccgcactgccagggctccagcgaacggcgattgatcagagttatccaggcgattttccaggctgggcttgcggacctggctggaggagggagaagccaatctagccgtggggcagagaggggcctctattgctgaggtggaagccattacctactgttggaccgggtgtctcagattcttcaagagcatggtcataatgtgactatgcttcatcagagtggaaagtttttgatcccagatattaaagaggaggaaaaatcataccaagttatcaggtggttttcacctgaagatcatcaaaaaagaattaagaagcattttgatagctacatagaaacagcattggatggcagaaaagaatctgaagcccttgtaaagctaatggaaatatttgggactcaatgtagttatttgctaagcagaaaggatataatggattccttaaagaatgagaactatgatctggtatttgttgaagcatttgatttctgttctttcctgattgctgagaagcttgtgaaaccatttgtggccattcttcccaccacattcggctctttggattttgggctaccaagccccttgtcttatgttccagtattcccttccttgctgactgatcacatggacttctggggccgagtgaagaattttctgatgttctttagtttctccaggagccaatgggacatgcagtctacatttgacaacaccatcaaggagcatttcccagaaggctctaggccagttttgtctcatcttctactgaaagcagagttgtggtttgttaactctgattttgcctttgattttgcccggcccctgcttcccaacactgtttatattggaggcttgatggaaaaacctattaaaccagtaccacaagacttggacaacttcattgccaactttggggatgcagggtttgtccttgtggcctttggctccatgttgaacacccatcagtcccaggaagtcctcaagaagatgcacaatgcctttgcccacctccctcaaggagtgatatggacatgtcagagttctcattggcccagagatgttcatttggccacaaatgtgaaaattgtggactggcttcctcagagtgacctcctggctcaccccagcatccgtctttttgtcactcatggtgggcagaacagcgtaatggaggccatccgtcatggtgtgcccatggtgggattaccagtcaatggagaccagcatggaaacatggtccgagtagtagccaaaaattatggtgtctctatccggttgaatcaggtcacagccgacacactgacacttacaatgaaacaagtcatagaagacaagaggtacaagtcggcagtggtggcagccagtgtcatcctgcactctcagcccctgagccccgcacagcggctggtgggctggatcgaccacatcctccagactgggggagcgacgcacctcaagccctatgccttccagcagccttggcatgagcagtacctcattgatgtctttgtgtttctgctggggctcactctgggcactatgtggctttgtgggaagctgctgggtgtggtggccaggtggctgcgtggggccaggaaggtgaagaagacatgaggctaggtgtagccttgggtgaggggagggcatccctggtcctttgaaggttctccccaccccagcacacgccacccctctgttctctcttcagctccacctgccactgatcttgcaacttgcttctttctattctctgcctctgtttagaaatcttcacgcaccactgaggcttcttgacttgccccttgtgacttgaaaccccagctcagatacaaattttcacctgccagccctgcctcctcctttctcccttttcctagacacaggactctgacaacttcatcctccttgtttagatgacttcccagtttccagtccccatttctc

SEQ ID NO: 27 - DNA, 2628 bp, Homo sapiens
  CDS (122)..(1651)
gatccccaccacaccaccagcccggccgcacggggcactgagccgggtgctgagcaccggaggccccgccgaggccgggactcaggacctgcagagaaacgcctcctgattttgtcttacaatggaacttaaaaagtcgcctgacggtggatggggctgggtgattgtgtttgtctccttccttactcagtttttgtgttacggatccccactagctgttggagtcctgtacatagaatggctggatgcctttggtgaaggaaaaggaaaaacagcctgggttggatccctggcaagtggagttggcttgcttgcaagtcctgtctgcagtctctgtgtctcatcttttggagcaagacctgtcacaatcttcagtggcttcatggtggctggaggcctgatgttgagcagttttgctcccaatatctactttctgtttttttcctatggcattgttgtaggtcttggatgtggtttattatacactgcaacagtgaccattacgtgccagtattttgacgatcgccgaggcctagcgcttggcctgatttcaacaggttcaagcgttggccttttcatatatgctgctctgcagaggatgctggttgagttctatggactggatggatgcttgctgattgtgggtgctttagctttaaatatattagcctgtggcagtctgatgagacccctccaatcttctgattgtcctttgcctaaaaaaatagctccagaagatctaccagataaatactccatttacaatgaaaaaggaaagaatctggaagaaaacataaacattcttgacaagagctacagtagtgaggaaaaatgcaggatcacgttagccaatggtgactggaaacaagacagcctacttcataaaaaccccacagtgacacacacaaaagagcctgaaacgtacaaaaagaaagttgcagaacagacatatttttgcaaacagcttgccaagaggaagtggcagttatataaaaactactgtggtgaaactgtggctctttttaaaaacaaagtattttcagcccttttcattgctatcttactctttgacatcggagggtttccaccttcattacttatggaagatgtagcaagaagttcaaacgtgaaagaagaagagtttattatgccacttatttccattataggcattatgacagcagttggtaaactgcttttagggatactggctgacttcaagtggattaataccttgtatctttatgttgctaccttaatcatcatgggcctagccttgtgtgcaattccatttgccaaaagctatgtcacattggcgttgctttctgggatcctagggtttcttactggtaattggtccatctttccatatgtgaccacgaagactgtgggaattgaaaaattagcccatgcctatgggatattaatgttctttgctggacttggaaatagcctaggaccacccatcgttggttggttttatgactggacccagacctatgatattgcattttattttagtggcttctgcgtcctgctgggaggttttattctgctgctggcagccttgccctcttgggatacatgcaacaagcaactccccaagccagctccaacaactttcttgtacaaagttgcctctaatgtttagaagaatattggaagacactatttttgctattttataccatatagcaacgatattttaacagattctcaagcaaattttctagagtcaagactattttctcatagcaaaatttcacaatgactgactctgaatgaattatttttttttatatatcctattttttatgtagtgtatgcgtagcctctatctcgtatctttttctatttctcctccccacaccatcaatgggactattctgttttgctgttattcactagttcttaacattgtaaaaagtttgaccagcctcagaaggctttctctgtgtaaagaagtataatttctctgccgactccatttaatccactgcaaggcacctagagagactgctcctattttaaaagtgatgcaagcatcatgataagatatgtgtgaagcccactaggaaataaatcattctcttctctatgtttgacttgctagtaaacagaagacttcaagccagccaggaaattaaagtggcgactaaaacagccttaagaattgcagtggagcaaattggtcattttttaaaaaaatatattttaacctacagtcaccagttttcattattctatttacctcactgaagtactcgcatgttgtttggtacccactgagcaactgtttcagttcctaaggtatttgctgagatgtgggtgaactccaaatggagaagtagtcactgtagactttcttcatggttgaccactccaaccttgctcacttttgcttcttggccatccactcagctgatgtttcctgggaagtgctaattttacctgtttccaaattggaaacacatttctcaatcattccgttctggcaaatgggaaacatccatttgctttgggcacagtggggatgggctgcaagttcttgcatatcctcccagtgaagcatttatttgctactatcagattttaccactatcaaatataattcaagggcagaattaa

SEQ ID NO: 28 - DNA, 2516 bp, Homo sapiens
  CDS (1063)..(1434)
ggccgaccaaccagaataatcggttctccagaaagagcgaaccgccccgcctagggaaggtcacagaggccccgttaccgcccagcatgtgtaaggccgccgcctggggcacaagcagacctttccccgcgtggagcaaacccgcaaatctttggggaaggaaggtgcccatccggtcgtccccccaagcaccaggtgaaagccccggcgccttggggccaagggccctcgaagcttggaaaggcttcggggcccaacaggctatagccaagccggcttcagaatccgggcccccgaccgcccaaggaaaaggtgcctctcacacaccggaggctccagcatggggcggcaatttcgggtccagggcacggcgtgtcagaggccacgggcgggaaactagaaggaacaggtgtggctggaagcctgggggcgaggggcatcggagaggcccgggaggctaaaaggagaacgcgggcgcagacaccgaggggcgccgcaggcgacgtgggctttttggaggaacagggacaggtcctgagacccctttgggccgaccacacccccctcctgcgtgcgggggcagacgtccccggtggggtagactggcagcctaatccacggcgcgggagggcaggtgggagactggaggcgccctcgcgcccctcagctatccgggagcctcgcgccggcgacctcgaccctgtcgaacccggcggacacgtcagaaagaagctgagcgcctcgcagcggccaggacagcgggccagcccgcgcgctcccgcagcgcacggccagacgcgacgcccctcagcacggaacccagcctcgcggactaccccgaagctcagagccacatcccgcgcagaggaccgcggcgaccggaaaagcaaggcagaggcggaaaaccaccgcgagcgctggggcgagagagggcaggcggaggctcgcggggaccaccagcatccccggaccctctcagccgtccctgttcacaggcaccgcccccaggagcctcggcaggggcctaggacgccccggcgtgcagaagagaagcgggatcagatggcgtcccatgtagagtgccgtcctctgggagtgtttgagtgtgaactctgtaccttgacagctccgtacagctatgtgggacagaagccccccaacacccagtcgatggtcctcctggaggaaagctatgtcatgaaggatcccttcacctccgacaaggacagattcctggtcctcggctcgtgctgcagtttgtgcagcaggctggtgtgtgtgggcccggaatgcagtttattctactccaagagattctgcctcccttgtgtccgggagaacatcaatgcttttcctcaggaaattcggcaagacttggagaaaaggaaagctccatcaaagaggacccccagccagcccggttctcggacgtgagtgcaactggggctaggtcatcgggcggcaccctgcacagagctcctgggccagcctgcgccagggatgctgctgagctgggagccgccatgcctggccttgtttctggaccactgggagcagcactgcagcccaggggagctggagtccagcttggagcagccacaggcccagggagctgtagcaagagggtagtccaaaggcagatgccagacaagacacagccaggaacccggccaggtccccccacatgcccctcagggcccaggcctgagtgagtgctgctcagatgtgactgagagggatgacctccttcagcagggcagctcctaagaggctgcgtgcaggtgcgtgtggggggagatgccacactgtgtcggggccatggtgcactgtaggtggctgcaatggtctctctgtaaggaaaatcactgacagcagctccttctggacccagtctggaaggtctagagggggatagaatttttatttcatatccttatgtggtgcttggaaaatgtttttaaccttgaccatgtattatgtttataattaaaaacccaaagaaccagctcatgtttggaaaaggaatcttccactgaaacatttggatacccgacgttctccctggacacttggcccggcaatagttggggtctcctgggaagctgagtgctggcttctagcctctccagttccctcagactctgtcttcagctcgggcccctccgttctgtctccctcgactccaagtcaggaataccgtgggcttcctgccctcaccccacacctcaagaccatcccactgcttgcctgcttgccccctgccatctcgcactcagccctgggtgcctgtgaagcctggccccactgcctgccgggggttcctgcagcacccccctactccaggctccccatctccctgaagcttccagggtagcagctggtgggacactgatctgtgagctctggaatgtctgcttagaattctgagaggcaggaactgctctgtctttgtaactactcaaggccaactgtcacatgaaggaatgaataaagagtttttactgaaaaaaaaaaaa

SEQ ID NO: 29 - DNA, 1208 bp, Homo sapiens
  CDS (299)..(1018)
aaaaataatggttgtacggacttctgaccgctcattatttggcaaaaaacctaataggtgtgaggtagtttcaaattctcaaaaaaaaagtttatagtgtattggggagacaaaccccaaatgagtcatagtgaaggttggagtagaatgggtagagtttgagaggaaggcctgtatcttaccgggggagggattgtagtctggggagcccagcccattcatgtacaggttcattattgacttgttagagagatgactggtgaaatgcctttttttatctacaaaaaaatatttttagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggcaagagggtggttttcctgaagcagctggctagtggcttattacttgtgactggacctctggtcctcaatcgagttcctctacgaagaacacaccagaaatttgtcattgccacttcaaccaaaatcgatatcagcaatgtaaaaatcccaaaacatcttactgatgcttacttcaagaagaagaagctgcggaagcccagacaccaggaaggtgagatcttcgacagaaaaagagaaatatgagattacggagcagcgcaagattgatcagaaagctgtggactcacaaattttaccaaaaatcaaagctattcctcagctccagggctacctgcgatctgtgtttgctctgacgaatggaatttatcctcacaaattggtgttctaaatgtcttaagaacctaattaaatagctgactacaaaaaaaaaaaa

SEQ ID NO: 30 - DNA, 1386 bp, Homo sapiens
  CDS (576)..(1175)
ttaactagttgggcattccaccacaacactgttgatgccatccatgatgtcatgagggtggtggccatcaacattgcagacacagactgggcagtagtcagtccccaggagctctttaatagttccagagagttctctggctaaagattggtgctgcatctgtcgagcagtgttgacaatctcatcaaaagtgatattcccactgtgtttaatgtttttctgtttctttctgtctcttggtggttccttgagggctttgatgatcagggcagaggcagaaggcaccacctcaatctgggcctgtctgttctgaatggtcagtttcactgtaatcctcaggcccttccagtcacccgttgccttggcaatgtcatcaccaactttttttggagacagacccagggggccgatcttgggggccagggcagaagtggcaccgacttcacctccggtgcacctcaggtatacgactttgatctcgttggggtcgaacttcggcggctcggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagctgtaagtgacattttcattgttacagtaggggtgaaaggggggccccccagtgtattcccagagataagctgggaagttttggaaatggttactggtggggtgggataatccttttaaactttttactgattttttttttctttcccacagagttaagcacaaaggaaaacatttcaataaaggatcatttgacaactggtggattttctggtgtggcgtcttccttgagggagctagctcctttgtggggtggtcagtggggtcagggtggcagaacctgtggagaagtaacaagcaccttgtggtgggtaaaaaaaaa

SEQ ID NO: 31 - DNA, 1917 bp, Homo sapiens
  CDS (90)..(1784)
gcgggtgtcactctttattgcggggtccacactgtgggtgctggggcccctcccactgagggaaggctgagcctctagccagggctgacatgttgaggactacgcgcggcccaggcctgggccccccgctgctccaggccgcgctgggccttgggcgggctgggtggcactggcctgcgggccgggcggcgagcggggggcgcgggcgggcctggctgcagcccacgggccgggagacgggtgtgcaggtgtacaacagcctcaccgggaggaaggaacccctaatcgtggcgcacgccgaagccgcctcctggtatagctgtggaccaactgtatatgatcatgcgcaccttggccatgcttgctcatatgttagatttgatatcattcgaaggatcctaaccaaggtttttggatgcagcatagtcatggtgatgggtattacagatgtagatgataaaatcatcaaaagagccaatgagatgaatatttcccccgcttccctcgccagtctttatgaggaagacttcaagcaggacatggcagccctgaaggttctcccacccacggtgtacctgagggtaaccgaaaatattcctcagataatttctttcattgaaggaatcattgctcgtgggaacgcttattcaacggcaaaaggcaatgtctacttcgatctgaagtctagaggagacaagtatggcaaattggtcggcgtggtccctggtccagtcggagagccagcggactctgacaagcgtcatgccagtgacttcgccctgtggaaggcggccaaaccccaggaggtgttctgggcctctccctggggacccgggaggccgggctggcacatcgagtgctctgccatcgctagtatggtatttggaagtcaactggatatccattcaggtgggatagatttagcttttccacatcatgagaacgaaattgcacagtgcgaagtctttcatcagtgcgagcagtggggaaattattttctgcattctgggcatttgcacgccaaaggcaaagaagaaaaaatgtccaaatcattaaagaactacattactattaaggactttctgaagaccttttcccccgatgtcttccggttcttctgcctgcggagcagctaccgctcagccatcgactacagtgacagcgccatgctccaagctcagcagctgctcctggggctgggctctttcctggaggacgcacgtgcctacatgaaggggcagctggcctgcggctccgtcagggaagcgatgctgtgggagaggctctccagcaccaagagggccgtgaaggcggccttggcagatgactttgacacacccagggtggttgatgccatcctgggccttgcacaccacgggaatggacagctcagggcgtccctgaaggaacctgaagggccgagaagtcctgctgtgtttggtgccatcatctcttactttgaacagttttttgaaactgttggaatttctctggcaaatcaacagtacgtttcaggagacggcagcgaggctaccttgcatggtgtggtggacgagctggtgcggttccggcagaaggtccggcagtttgcgctggccatgcccgaggccacgggggacgcccggcggcagcagctcctagaaaggcagcccctgctggaagcatgcgacaccctgcgccggggcctgactgcccacggcatcaacatcaaggacagaagcagtacaacatccacgtgggaactgctggatcaaaggacaaaagaccaaaaatcagcgggctgaggatggagcacagccatgaacctgctcacgacaagacgcacccatgcttctcagggtcaaggctttatgttaaagcttcctgtcggggctgctaggtcagcattaaagtaaggcaaccaacaaaaaaaaaaaa

SEQ ID NO: 32 - DNA, 2205 bp, Homo sapiens
  CDS (142)..(2205)
atttaccgcatttacggctgcattctctctgtccccagcaagcgggtcccacctttcccggtcccagccccacgcaccgccgctcggaactacacttcccggcagaacgcgggcgcgcgcacgcgcaccggggcctcagccatggcgaccgtgctgtccagggcgctcaagctgccggggaagaagagcccagacctaggggagtatgatccacttacccaggctgacagtgatgagagcgaagacgatctggtgcttaacctgcagaagaatggaggggtcaaaaatgggaagagtcctttgggagaagcgccagaacccgactcagatgctgaggttgcagaggctgcaaagccacatctttcagaagtcaccacggagggctacccctcagaaccccttgggggcctggaacagaaggcggcctcctccctggtgtcatatgtgcgcacgtctgtcttcctgctgactttggggatctcgatgatcctggtgctcctgtgtgctttcctgatcccctgtcctcccagagatctgcacagcacctggagccgccacttgggctcccagggagagttgtcttatgtttgttttatgtacagtgtccagggcttttccatgcacttagcagggggagtagggagaggtgtgtctactatacctagtcgaggaactggagtctgcctggtgtttatagagctactggcaacagagaactggtttgtggtaacttgctcaggacctttttggttttttatgtgtataacaggtggggacctgtctccattggaattggctgatgtgaatggagatggcctgcgtgatgtgcttctctcctttgtgatgtcaaggaacgggagtgcagtaggtgtctcaagaccagctgctaatcttgtatgcctttcggggatgaatggcagcacactgtggtctagtcttctccctgaggaggctcgagatatcacatgtttggagctgatgccaggaagcttggctgaaaccatctgccttgtgacagggacacacaagatgctcagcgcattcaatgcaacgtcagggaaagccatttggactttaaacccaaactacttgtccaacggtaccttggctgccccagttgtggtactgccagacttggatgaagacggtgttcgagaccttgtggttctggccattggggaattgcagccagatctgtgctttctgctggtgtctggccggaccggaaatccagtgggtcgacctgtgaagtacaacatcgttggagttgggaatctgattggtcctcaggtttacatcaccacaaatggggctgtctacatcctgtttggctttggaaatatacaagctgtcgcactgcgggacatttttgttcaggcccaaaatcgagacagctcaccaccttctctgcagatagaagagccagaatgggaaaagcgaagatccatcaacctgtctgagctcattgatgtttacagtgatggtgttgaactactccagatggtgaaggcaccagattccaactgcagcaaccttctgattacaaccagacaaagccttgtgctgcttcgggggcaaaatctgacaccttactgggcattgagacttcaaggcctgcgcagccagcctactcctggatatttcactgatgatcagacattagacttccttctgcagatacaggatggagttgggatgaaaaagatgatggttgtggatggtgactctggctccattgtttggagttaccgtgctccgtgtcacatgaaagaaacgccagccacctcagcagttacttcagaccagaagtctgtcttcctcttctgggccgaagggctgtcagctgcatctcccaattccgatatcatcctaggaactgagccgcccagccttcaccacctttacctcctgcatcctgcgttcccctccatccttctggatctggccaacaccaccggcacagtgacggcttcagaggttggaattaacgacctctggaaagatgccttttatgttaccaggacaacagggccaagctccgaaggccatccagcagccctggtggtcagcaagcttagtctacggtgggcactaatggagggccagatggctcagctacaggagtccacccccaaaattggccgtggggagctgcgaagatttctctctaggataaagtttgttgaagctccctacgagatctaa

SEQ ID NO: 33 - DNA, 1335 bp, Homo sapiens
  CDS (52)..(891)
ccggcccgggccaggacagcgggcggcgggcggcgcgggcctggccccgggatggctatgttccgcagcctggtggcctcggctcagcagcggcagccgccggccgggccggcgggcggcgacagcggcctggaggcgcagtacacctgccccatctgcctggaggtctatcaccggcccgtggccatcggcagctgcggccacacgttctgcggggagtgtctccagccctgcctgcaggtgccatccccgctgtgcccactgtgccgcctgcccttcgaccccaagaaggtggacaaggccacccacgtggagaagcagctctcatcctacaaagcgccctgtcgaggctgcaacaaaaaggtgaccctggcaaagatgagagtgcacatttcgtcctgcctgaaggtccaggagcagatggccaactgccccaagttcgtccccgtggtgcccacatcacagcctatccccagcaacatccccaacaggtccaccttcgcctgcccgtactgtggtgcccgcaacctggaccagcaggagctggtgaagcactgtgtggaaagccaccgcagcgaccccaaccgcgtggtgtgccccatctgctcggcaatgccctggggggaccccagctacaagagcgccaacttcctgcagcacctgcttcaccgacacaagttctcctacgacacctttgtggtaggcatcccgccagcaccgtcctcccccacgccctcctcatccaccctcctcctgctcgggcccctcgccagcctcagggtccgcagggttcagaggaagccagaaacagaagcctcgtttcaggactacagtattgacgaggaggccgccttccaggctgctctggccctgtctctctctgagaactgaagggaagcgcagccacctgcctgcgtctggggtcagggatgtccccgctcctgtgtcgcacctggcacctgctcgggagtgcacctcaccggattgagctcaggcgagccatggggtttgctgtggggtctgccctggccacccactgtgtgtttgggtccttgaggtttgtacgtttctctttgatgaccaggaagaaatcccagcaccccagccacaggctgtggttgctcccagcaaaggcggggccggcaaaaaaggggcctcctccacccaaagtcctggccttggcccgctgtcaccttcaaagctgactgtgccccgctgcgggaggggacggcaccccagtggtggcaaagcttgggggcctgggcaggggcccgcttggcgggccgggcaacacgtcaacattcttttctgttcttggcattaattattgctgtc

SEQ ID NO: 34 - DNA, 1397 bp, Homo sapiens
  CDS (645)..(1379)
tgttaggccttctcaagtgggaatcaggaacgctgctgtgctctagagatgttttgttcttcctgtagggctgaagcagtgcctactcgatagaatcagtcatcatgcaaataaaagccacctgagtcaaaggcaaagccagagtgcagcttggagcaaagaagttaaaagcatattggcagaggaagagccctggcattccagcaggagctaacaggaaaaagaaaatcaatggcagtagccctgacacagccacttctggtggttaccactcacctggggattcagcaacaggtatctacggggagggccgtgcatcctctactaccctggaggatctggagagccagtaccaagaactagcagtggccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccacagcccccagcagggccatctaaggtggagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggctgtgtgaacaggaggagaggctgtgtgaacaggaggagaggctacgtgaacaggaggagaggctgtgtgaacaggagaagctgccagggcaggagaggctgctggaagaggtggagaagctgttagaacaggagaggcggcaggaggagcaggagaggctgctggagagggagaggctgctggacgaggtggaggagctcctggagcaggagaggcttcggcaacaggatgagaggctgtggcagcaggagactctgcgggagctggagaggttgcgggagctggagaggatgctggagctggggtgggaagccctgtacgagcagcgggccgagccacgcagcggcttcgaggagctgaacaacgagaacaagagcacactgcagttggagcagcaagtaaaggagctggagaagtcgggtggagctgaagagccaagaggctccgagtctgcagcagcagccagaccagtacctggagccccagtcccacaaggagcttggatgtgcggacaagcagggtggactccccaggagcacccaggcttgagtggagaagctgttggtacaggagaggcggcaggaggagcaggagaggctgcatgccattcttttcgggctgccgagaacagggagctaaacatcaccatcatctaagagcgggtcaagaaattg

SEQ ID NO: 35 - DNA, 2311 bp, Homo sapiens
  CDS (43)..(1989)
ctgactgtgatccgaagagtggatgaaaactgggctgaaggaatgctggcagacaaaataggaatatttccaatttcatatgttgagtttaactcggctgctaagcagctgatagaatgggataagcctcctgtgccaggagttgatgctggagaatgttcctcggcagcagcccagagcagcactgccccaaagcactccgacaccaagaagaacaccaaaaagcggcactccttcacttccctcactatggccaacaagtcctcccaggcatcccagaaccgccactccatggagatcagcccccctgtcctcatcagctccagcaaccccactgctgctgcacggatcagcgagctgtctgggctctcctgcagtgccccttctcaggttcatataagtaccaccgggttaattgtgaccccgcccccaagcagcccagtgacaactggcccctcgtttactttcccatcagatgttccctaccaagctgcccttggaactttgaatcctcctcttccaccaccccctctcctggctgccactgtccttgcctccacaccaccaggcgccaccgccgctgctgctgctgctggaatgggaccgaggcccatggcaggatccactgaccagattgcacatttacggccgcagactcgccccagtgtgtatgttgctatatatccatacactcctcggaaagaggatgaactagagctgagaaaaggggagatgtttttagtgtttgagcgctgccaggatggctggttcaaagggacatccatgcataccagcaagataggggttttccctggcaattatgtggcaccagtcacaagggcggtgacaaatgcttcccaagctaaagtccctatgtctacagctggccagacaagtcggggagtgaccatggtcagtccttccacggcaggagggcctgcccagaagctccagggaaatggcgtggctgggagtcccagtgttgtccccgcagctgtggtatcagcagctcacatccagacaagtcctcaggctaaggtcttgttgcacatgacggggcaaatgacagtcaaccaggcccgcaatgctgtgaggacagttgcagcgcacaaccaggaacgccccacggcagcagtgacacccatccaggtacagaatgccgccggcctcagccctgcatctgtgggcctgtcccatcactcgctggcctccccacaacctgcgcctctgatgccaggctcagccacgcacactgctgccatcagtatcagtcgagccagtgcccctctggcctgtgcagcagctgctccactgacttccccaagcatcaccagtgcttctctggaggctgagcccagtggccggatagtgaccgttctccctggactccccacatctcctgacagtgcttcatcagcttgtgggaacagttcagcaaccaaaccagacaaggatagcaaaaaaaaaaaaaagggtttgttgaagttgctttctggcgcctccactaaacggaagccccgcgtgtctcctccagcatcgcccaccctagaagtggagctgggcagtgcagagcttcctctccagggagcggtggggcccgaactgccaccaggaggtggccatggcagggcaggctcctgccctgtggacggggacggaccggtcacgactgcagtggcaggagcagccctggcccaggatgcttttcataggaaggcaagttccctggactccgcagttcccatcgctccacctcctcgccaggcctgttcctccctgggtcctgtcttgaatgagtctagacctgtcgtttgtgaaaggcacagggtggtggtttcctatcctcctcagagtgaggcagaacttgaacttaaagaaggagatattgtgtttgttcataaaaaacgagaggatggctggttcaaaggcacattacaacgtaatgggaaaactggccttttcccaggaagctttgtggaaaacatatgaggagactgacactgaagaagcttaaaatcacttcacacaacaaagtaacacaaagcagcttaacagaaagagcacatttgtggacttccagatggtcaggagatgagcaaaggattggtatgtgactctgatgccccagcacagttaccccagcgagcagagtgaataagatgtttgtgtggcatctgttagtctggattctgatgtataaggggtgccttgtactgtctgatttactacacagagaaactttttttttttttacaatatgtgattaaatgggccaatggttaacacggctaacctaatgtattggtttttt

SEQ ID NO: 36 - DNA, 1799 bp, Homo sapiens
  CDS (124)..(831)
aatttgtacactcctatagggaatttggtctcgagcagtaattcggcacgaggtattttgatgttatattagcattcctgttgctgattttctgtcttgagggaaaaagttattcaggagagtatgttgatcttggttcataatccatctccagggtcgacgatttcgtcgggcggccagggccgccggaggaagcagccccccatgccggccgacttcaagttgcaggtcatcattatcggctcccgcggcgtgggcaagaccagcctgatggagcgcttcaccgacgacaccttctgcgaggcctgcaagtccaccgtgggtgttgacttcaaaatcaaaactgtagagctaagaggaaagaaaattagattacagatctgggacacagcaggtcaggagagattcaacagcattacctcagcttattacagaagtgccaaggggatcatattagtatatgatatcactaagaaggagacatttgatgatttgccgaaatggatgaagatgattgataagtatgcttcagaagatgcagagcttctcttagttggaaataagttggactgtgaaacggacagagaaatcaccaggcagcagggggaaaagtttgcacagcagatcactgggatgcggttctgtgaagcaagtgccaaggataacttcaatgtggacgagatatttttgaaacttgtcgatgacattctgaaaaagatgcctctggatattttaaggaatgagttgtccaatagtatcctgtcgttacaaccagagcctgagataccgccagaactgcctccaccaagaccacatgtccgatgctgttgatttcctactttggagacaaagtggaaatgattcctggaaaggggaaaaaacgttctattctgcactacaatcattttgacaatttcctttcgcactttgtaatccaagtcagagctatacactaacttgtaaatatgcatatatgcaatcctgggtaagttttggttataagttacctatttccctccaaattattatatttcattcattaccccagtgtctagtgtacatacactgggaaacctagtacttctaatatgaagaatgggagaaatgaaaggtataatgtttcttgaaataaataatataattgtccttattaattatattatgaggacagaagatattctgataagagagaacgtggtgctttgcttaccgttttaaagaaaatttgtaaaactaaagactttttgaaaaaaagctatcttaagtgctttttctttatttacaagacatttcccccagtggtagcatctgaagtattggagtgtttctgccacgaagcaaagctccattcatggccgtcatggaaggttatttattaatgttacataatggtagaatattactagttagagggttggatttgacttggtcctaaggccacagaatctctctcatggcttcctaagggatgtacctttatgcttttaagaactacaaagattcaataaagaaagaaatgtttttgaaactatagaaaaagattttaaaacacgctgctgtcctaaacaaatcctgtttaaaggaattttaaagagatgcattttactatatcaaagaacatacgtgtatttgcctaaacactctgtacctttgtaatgataaaacttcccccttctttacggtgaagcttattctgattaagcctagactgtgttctttttttttttttttgggcgggaaaaaaaattggaaacctttattttgggaatattttaaataaaccgcccctgttttgtaag

SEQ ID NO: 37 - DNA, 1059 bp, Homo sapiens
  CDS (227)..(889)
cggtccgaacctcccgggtcgacgatttcgtctttgcgagagtagcgcgggagctgagaagttgcagggttgagttggtcccggcaagtccttgagcagtttgttcctctgtcttcccgcttcctggtgccccgactgcgtccccacgaacgccccgtccttaccgccggctgctgtggagtgcctcgctgtctcccaggtccccgagttcctggtttcagagaagatgaccgaagaagtggatttcctgggacaggactctgatgggggtagtgaggaagtggtcctaactcctgcagagctcattgaaagattggagcaggcctggatgaatgaaaagtttgcccctgagctgctggagagcaagcctgagattgtagaatgtgtcatggaacagctggagcacatggaagaaaatctcaggagagccaaaagggaggacctgaaggtcagcatccaccaaatggagatggagaggatccgctacgtcctcagcagctacttgcggtgtcgcctcatgaagatagagaagtttttccctcatgtccttgagaaggaaaaaacacgtcctgagggggagccttccagcctctcgccggaagagttggcctttgccagagagttcatggcgaacacagagtcctatctgaaaaatgtcgccttgaagcacatgccccctaacttacagaaggtggacctctttcgggcagttcccaaaccagatctagattcttacgtgtttctgagagtgagagaacgacaagaaaacatactggtagaaccagacacagatgagcagagggactacgtgattgacctggagaagggctcacagcacttgatccgatacaaacatggactctgctgctctggagctgtccgctattaaacaggctaacgcagctgggacaagcgggccgcttggagcgaggggggtcacgagggggtcaacacgcctggggccccttcaaaaacaggcgggggggggccacccccggcgcaaaaacgaagggggcgcccccgcggggcaaaaaagcccccgcctgacgaatagtgaca

SEQ ID NO: 38 - DNA, 2214 bp, Homo sapiens
  CDS (607)..(1707)
gcagagggctccggcacacggaaggtaggagctcggagccctaagggtcggtccaagtgtctgcgagaagcccgcagcgcccaggaccgcgtggagcgctcggggcgcgccaagccgcacttagccaaaagagaaacgctgacgggccgtaggcgggttggctgggacgcggaatacgcgcggccccggagcgcctttcgttttaaggagccttacttctggaaagggacagggaactgtcaatcagcgagggagggagcgcaccggcgctgggtgatgtcagcggatcagctgctcgataacaaagagagggtattacaggagaaagttgcagcagcggcagcggccaaggcggcacaccggagcctccgaggcgaggggcaagtgggcgaagggaggggggacgacggctgctgccgcagcagctgaaggccaaggaattgaaagggctgtagggggaggcagtgcgagccagccccgactgctcctcctcttcctcctcctcctccaaactcgcgagccccagagctcgctcagccgccgggagcacccagagggacgggaggcagccgcgcagccccgagctgggcagtgtccccagccgccatggatagcgacgacgagatggtggaggaggcggtggaagggcacctggacgatgacggattaccgcacgggttctgcacagtcacctactcctccacagacagatttgaggggaactttgttcacggagaaaagaacggacgggggaagttcttcttctttgatggcagcaccctggaggggtattatgtggatgatgccttgcagggccagggagtttacacttacgaagatgggggagttctccagggcacgtatgtagacggagagctgaacggtccagcccaggaatatgacacagatgggagactgatcttcaaggggcagtataaagataacattcgtcatggagtgtgctggatatattacccagatggaggaagccttgtaggagaagtaaatgaagatggggagatgactggagagaagatagcctatgtgtaccctgatgagaggaccgcactttatgggaaatttattgatggagagatgatagaaggcaaactggctacccttatgtccactgaagaagggaggcctcactttgaactgatgcctggaaattcagtgtaccactttgataagtcgacttcatcttgcatttctaccaatgctcttcttccagatccttatgaatcagaaagggtttatgttgctgaatctcttatttccagtgctggagaaggacttttttcaaaggtagctgtgggacctaatactgttatgtctttttataatggagttcgaattacacaccaagaggttgacagcagggactgggcccttaatgggaacaccctctcccttgatgaagaaacggtcattgatgtgcctgagccctataaccacgtatccaagtactgtgcctccttgggacacaaggcaaatcactccttcactccaaactgcatctacgatatgtttgtccacccccgttttgggcccatcaaatgcatccgcaccctgagagcagtggaggccgatgaagagctcaccgttgcctatggctatgaccacagcccccccgggaagagtgggcctgaagcccctgagtggtaccaggtggagctgaaggccttccaggccacccagcaaaagtgaaaggcctggctttggggttcagagacctggaatagatacttggatctatgcactacgtttatctgatcaatgggactaccagggactgctcatgctgtgacgtcacatcctctcaccatgcgttagctacgactttctcgcatactaactaggtttgactgtattactcataccagatttaatattagctagccttgcaacaacgtcctactgagaggtattgtcgagcatttgacataagacagcgtgatgttctttggtggttcaagtctgaatctgtaccacattcggagatgccaaatgattagactgaaacagggaaacggggtttttcagtcatttttagtcagtggtttttccatagtgcttgtttcctatggccagtgcaaattgtgttagcacacttgcatatgtgccgtattaaggggtgacaattactacatcttgattctctataatgtagtataatttgccttttaacctttgatctgtatcttgctatagaag

SEQ ID NO: 39 - DNA, 1379 bp, Homo sapiens
  CDS (396)..(1379)
cgaaggcttcttcctactctcctgcaccttctcctccttgagtcaaggcctccggatccacatggatagctgagatcttttcttggagaaagacgctttcctctttactccagtccctcacttccccacctgattttcctcctcttctgctggtcctgtctttttctactgcctctttattcaatttcttgcttgtgtgcccctttgggactctcttgtacactttcctccatctccactatctcaggatctgtgtgtgtgctgccttcctcctgtgtgctttctgtccccccatctctgtcttgtctttcccacttctattgccaaagggagagatcctctccgggctgttccctggcctgtctgctcctccgggctctgtcccagcagcgacaatgagctccacactccactcggttttcttcaccctgaaggtcagcatcctgctggggtccctgctggggctctgcctgggccttgagttcatgggcctccccaaccagtgggcccgctacctccgctgggatgccagcacacgcagtgacctgagtttccagttcaagaccaacgtctctacggggctgctcctctacctggatgatggcggcgtctgcgacttcctatgcctctccctggtggatggccgcgttcagctccgcttcagcatggactgtgccgagactgccgtgctgtccaacaagcaggtgaatgacagcagctggcacttcctcatggtgagccgtgaccgcctgcgcacggtgctgatgcttgatggcgagggccagtctggggagctgcagccccagcggccctacatggatgtggtcagtgacttgttccttggtggagtccctactgacatacgaccttctgccctgacccttgatggagttcaggccatgcccggcttcaaggggttaattctggatctcaagtatggaaactcggagcctcggcttctggggagccggggtgtccagatggatgccgagggaccctgtggtgagcgtccctgtgaaaatggtgggatctgctttctcctggacggccaccccacctgtgactgttctaccactggctatggtggcaagctctgctcagaagagcatggggctgctgacaatggttatgactgcgggatgggattcagggctctgccggcaaacgtgtggtgttctggcctcagcagccacccagtgaggcagcctcaaaactctggttttagtgaagtgactgggattggacccaaggctccggaggtagttggagcacaggtgcaccacaccggagcttcgctggacaggatgacctcttcaaacttacctttggtttcccaggtaccaggcaatgcccattacctcactcagggttggtggtga

SEQ ID NO: 40 - DNA, 2575 bp, Homo sapiens
  CDS (44)..(2575)
tttcgtccggatccgagcgcaaagtctgggcctccccaggaagatgtgggggaggctctggcccctcctcctcagcatcctcacagcaactgcagtcccaggacccccactgcggagaccgtctagagaactagatgccacccctcggatgaccataccctatgaagagctctctgggacccggcacttcaagggccaagcccagaactactcaacactgctgctggaggaggcctcagcaaggctgctggtgggagcccgaggtgccctgttctctctcagtgccaacgacataggagatggggctcacaaagagatccactgggaagcctccccagagatgcaaagcaaatgtcatcaaaaagggaaaaacaaccagacggagtgctttaaccatgtgcggttcctgcagcggctcaattctacccacctctatgcatgtgggactcacgccttccagcccctctgtgcagccattgatgctgaggccttcaccttgccaaccagcttcgaggaggggaaggagaagtgtccttatgacccagcccgtggcttcacaggcctcatcattgatggaggcctctacacagccactaggtatgaattccggagcattcctgacatccgccggagccgccacccacactccctgagaactgaggagacaccaatgcattggctcaatgatgcggagtttgtgttctccgtcctcgtgcgggagagcaaggccagtgcagtgggtgatgatgacaaggtgtactacttcttcacggagcgtgccactgaggagggctctggcagcttcactcagagccgcagcagtcaccgtgtggcccgtgtggctcgtgtctgcaagggagacctgggagggaagaagatcctgcagaagaagtggacttccttcctgaaagcccgtctcatctgccacattccactgtatgagacactgcgtggggtctgcagcctggatgctgaaacctcaagccgtacacacttctatgcagccttcacgctgagcacacagtggaagaccctggaggcctcagccatctgccgctatgacctggcagagatccaggctgtctttgcaggaccctatatggaataccaggatggttcccggcgctggggtcgctatgagggtggggtgcctgagccccggcctggctcgtgtatcacagattcattgcgcagccaaggctacaattcatcccaagacttgccatccctggtcctggactttgtaaagttgcacccactgatggctcggcccgttgtgcccacacgtggacggcccctgctgctcaagcgcaacatacgctacacacaccttacagggacacctgtcaccacgcctgctggacctacctatgacctgctctttctgggcacagctgatggctggatccacaaggccgtagtcctgggctctgggatgcacattattgaagagacacaagtgttcagggagtcccagtctgtggaaaatctagtcatctctctattgcagcacagcctctatgtgggggctcctagcggagtcatccagctaccactctccagctgctcccgctaccgatcctgctatgactgcatcttggcccgagacccctactgtggctgggaccctggcacccatgcctgcgcagcagccaccaccatagccaacaggtcccagggaagcaggacagcactgatacaggacatagagagaggaaatcgaggctgtgagagcagcagggatacagggccaccaccaccactgaagacccgctctgtgctccggggtgatgatgtcctcctgccctgtgaccagccatccaacctggcccgggccttgtggctactcaatgggagcatgggcctgagcgatgggcagggtggctaccgtgtgggcgtggacgggctgctggttacagatgcacagcctgagcacagtggcaactatggctgctatgccgaggaaaatggcctccgcaccctgctggcctcctatagtctcacagtccggccagccactcctgccccagctccaaaagcccctgccacacctggggcacagctggcacctgatgtgagactgctctatgtgctagccattgccgcgcttggtggcctctgcctcatcctggcctcctccctcctctatgtggcctgtctgcgggaaggcagacgagggcgccgacggaaatactcactgggtcgggccagccgggcaggaggatctgcggtgcaactgcagacagtctcaggccagtgtcctggagaggaagatgagggtgatgatgagggggctgggggcctggagggcagctgtctccagatcatccctggggagggagccccagccccaccacccccaccgcccccaccgccaccggctgagctgaccaatggcttggtggcactgcccagccggctgcggaggatgaatggcaatagctatgtgcttctgaggcagagcaacaatggagtaccagcagggccctgctccttcgccgaggaactcagccgcatcctggaaaaaaggaagcacacgcagctcgtggagcagctagatgagagctctgtctga

SEQ ID NO: 41 - DNA, 715 bp, Homo sapiens
  CDS (514)..(687)
gacaggtatactgttagatgagacgttattatgtctgtggtattgagctgtacagggggtttgctgtattatctcaaactacctgtagtgtatttgtagggatgggtgagagtaactgtgcttggaatagaaaagccctgctgcatcgagacacaatgctggcagctgcggcagtgtacagaggtaaggggcgaccactctttcacccgcctcaccaaggcacttgtgctgtatcatgttgattcccttcacgttgccaatgcattttccattcctgttaaggctccctcagacttcttgtccttcctctcaaaacacagatcctgtagctttttccagacagcctttactatttccttaccctcagtattaagaatttttcatgtaagatgttctcagaatcttacaagtatccttgtacccatttctttttgaagaacatgacctttattgagcagaaattttttcctacttgcattttttcagactttaaccattattgtctttttagaaatgtacagaaatgaagatggttcagtacctgctacataccagatctattacatgataggatggaaatatcatgagtcacaggcaagaccagctgaaagaggttccgcaactgtgtcatttggagagctaggaaaaataaacaaccttatgccaccggggaaaaaatcacaataaatatttattcagtgttaaaaaaaaaaaa

SEQ ID NO: 42 - DNA, 2056 bp, Homo sapiens
  CDS (159)..(1730)
gcaagccaaacccacgaattaagctcttgactgcccatccacaagccccagtgccaagcacatataaaggcacctgccagtcctcactacaaccagcagaaccttttgggattttgccttcctccctcctgcatctgagctttgtctccaccagcaacatgagccgccaattcacctgcaagtcgggagctgccgccaaggggggcttcagtggctgctcagctgtgctctcagggggcagctcatcctccttccgggcagggagcaaagggctcagtgggggctttggcagccggagcctctacagcctggggggtgtccggagcctcaatgtggccagtggcagcgggaagagtggaggctatggatttggccggggccgggccagtggctttgctggaagcatgtttggcagtgtggccctggggcctgtgtgcccaactgtatgcccacctggaggcatccaccaggttaccgtcaatgagagcctcctggcccccctcaacgtggagctggaccccgagatccagaaagtgcgtgcccaggagcgagagcagatcaaggctctgaacaacaagttcgcctccttcatcgacaaggtgcggttcctggagcagcagaaccaggtactggagaccaagtgggagctgctgcagcagctggacctgaacaactgcaagaacaacctggagcccatcctcgagggctacatcagcaacctgcggaagcagctggagacgctgtctggggacagggtgaggctggactcggagctgaggaatgtgcgggacgtagtggaggactacaagaagaggtatgaggaggaaatcaacaagcggacagcagcagagaacgagtttgtgctgctcaagaaggatgtggatgctgcttacgccaataaggtggaactgcaggccaaggtggaatccatggaccaggagatcaagttcttcaggtgtctctttgaagccgagatcactcagatccagtcccacatcagtgacatgtctgtcatcctgtccatggacaacaaccggaacctagacctggacagcatcattgacgaagtccgcacccagtatgaggagattgccttgaagagtaaggccgaggctgaggccctgtaccagaccaagttccaagagcttcagctggcagctggcaggcatggggacgacctcaaaaacaccaagaatgaaatctcggagctcactcggctcatccagagaatccgctcagagatcgagaacgtgaagaagcaggcttccaacctggagacagccatcgctgatgctgagcagcggggagacaacgccctgaaggatgcccgggccaagctggacgagctggagggcgccctgcaccaggccaaggaggagctggcgcggatgctgcgcgagtaccaggagctcatgagcctgaagctggccctggacatggagatcgccacctatcgcaagctactggagagcgaggagtgcaggatgtcaggagaatttccctcccctgtcagcatctccatcatcagcagcaccagtggcggcagtggctatggcttccggcccagcatggtcagcggtggctatgtggccaacagcagcaactgcatctctggagtgtgcagcgtgagaggcggggagggcaggagccggggcagtgccaacgattacaaagacaccctggggaagggttccagcctgagtgcaccctccaagaaaaccagtcggtagagaagactgccccggaccccgcctcattccatgacccggctctggatcccacactgtacttcccacagcccactctcagctccatctccaccctgctggtcctgctcccatacacctggcactggccttggccacccacttctcccagcctgtgtcttcctgatcctgggaaggcctggatgaccaagcttggtgaaattcctccctgtacacaccctattaactccttggctgtggtcccccagctacaccaccagcccaggtcctggctgccagctttcctcctctgcccggcctctagcgcagtcgctaactactctgctgcg

SEQ ID NO: 43 - DNA, 911 bp, Homo sapiens
  CDS (38)..(760)
cttggaaacccacccagaacctttaccctctgacaccatggtcagctcctgttgtggttccgtctgctctgaccagggctgtggcctggagacctgctgccgccccagctgctgtcagaccacctgctgcaggaccacctgctgccgccccagctgctgtgtgtccagctgctgcagaccccagtgctgccagtctgtgtgctgccagcccacctgctgccgtcccagctgctgtcccagctgctgtcagaccacctgctgcaggaccacctgctgccgccctagctgctgtgtatccagctgctgcagaccccagtgctgccagtctgtgtgctgccagcccacttgctgccgtcccagctgcagcatctccagctgctgtcgccccagctgctgtgtgtccagctgctgcaagccccagtgctgccagtctgtgtgctgccagcccacctgctgccaccccagctgctgcatctccagctgctgtcgccccagctgctgtgtgtccaggtgctgcaggccccagtgctgccagtctgtgtgctgccagccaacctgctgccgtcccagctgctgcatctccagctgctgccgcccctcttgctgtgaatccagctgctgccgcccatgctgctgccgcccctgctgctgcctgcgtccagtctgtggccgagtctcctgccacaccacttgctatcgcccaacctgtgtcatctccacctgtccccgccccttgtgctgtgcctcctcttgctgctgagcccactgccctggctcacgtcccccttcaccactggcccacagatgtagacccttctactgtgctgaccattaggatacatgaagtggggttgatgtcattcaataggatggaccttatgcttccaaagagcccaccaccatttcactga

SEQ ID NO: 44 - DNA, 663 bp, Homo sapiens
  CDS (1)..(546)
atgtttttcatgaagttttatgaagattctgtttttcccaaaggagaaatagccaaagctgtgtttattgatagctgtgatgaggaaaatgaaggccaacaggtagcagtgggggaggttccttcaagtcttcataccacccattacaaggaaaactttagcatccgcctttcagggtttccagatcttagagctactgtgaaggggatgtgtcttcagagaaggggtgggcaaaaccaggaggtttttgtaatacacttacacagtgtgactatgggaacaacagactcgcttttgggaaggggaaccaagtggtggtcataccaagtaggtcctgtgagtttgtgcaatggtgtcacctacggtatgaatactggaggaacaattgataaactcacatttgggaaagggacccatgtattcattatatctggtgagtcatcccaggtggcaccacgtgcaaccccatgggccagtgtcactaatcctttctctggagatatcacttattactatggtgaggcttgctgtagatgttgtaactaattttcttacagaggtctgggaagggaaaagcattactatctatcttgaatattcatggttctttaggtcaaacacattaaaatttgactttaatcattcaatgggtatttgaaaatg

SEQ ID NO: 45 - DNA, 810 bp, Homo sapiens
  CDS (16)..(570)
tttcgtgtgcctagaatgggcattgtctctgctgcccccacccttggaatatctcgcctctccccagtcacctgggggtgggttctgtttgagttaggtgtctgcgcccaccccggagacctctctcgtggaagaggcaagagtgggtgtactggcttcggtcctgacccagggggttggggtgggggcctgactcaccctcccatcactccttccccatttcctttctctcaccctcctgggctccttccttttcccaatccccctctacccccgtccagactatctggctttccctgctcttgctccttcctctcctgtcttctctctccctgctaccttccctccctgcttcccccatttctgtctgccctccttccactttcccatatattcgcctgtgtccttgctgactcctgggcgaggctgagtggcacagtcacttggttccatgtcacctcctcggttccatttcacttcccccatcccatcatgtcctgcggatggtttcctgccctggagtcagagcgggaccacgtgtcgcatcgagttgctgttttctgtgcatgatgcttgaatccgtgacttcctgggtatttctggcctcgggttttcggggagcctaggccagttgcgcaggacatctctctggttctgtctgtcctggcgagtggatcagggaccacaaaaggcagctgagatgtgaacgacgacccttactccatgttttttcattcttttaaaagcacttttacccctttttataatgagtaagtgatctgtggatgaagccagggcagaccctgggaa

SEQ ID NO: 46 - DNA, 5754 bp, Homo sapiens
  CDS (379)..(5754)
tttcgtgggattactgaagaagaaggggggaaaaaaaaagaaagaaatctgagctttctgggaggaaattcaaaggaaccaagagaaattaacttcgttctgcaaggactaaagtacagcaagaggagagaggtcaagcgagaagcgtgcgggaagcacatgccctggggaggcatagaagccacactggcagagcggccagcacaggtagccagcagaggcattcttggggctatttgaaaaagtttggtctgtgaacaaaacagtttccctggtgactgcaaatccattgctagctgcctctttctcgtctgcccatcactctggtgtggtacccagaagttgacttctggttctgtagaaagagctaggggaggtatgatgtgcttaaagatcctaagaataagcctggcgattttggctgggtgggcactctgttctgccaactctgagctgggctggacacgcaagaaatccttggttgagagggaacacctgaatcaggtgctgttggaaggagaacgttgttggctgggggccaaggttcgaagacccagagcttctccacagcatcacctctttggagtctaccccagcagggctgggaactacctaaggccctaccccgtgggggagcaagaaatccatcatacaggacgcagcaaaccagacactgaaggaaatgctgtgagccttgttcccccagacctgactgaaaatccagcaggactgaggggtgcagttgaagagccggctgccccatgggtaggggatagtcctattgggcaatctgagctgctgggagatgatgacgcttatctcggcaatcaaagatccaaggagtctctaggtgaggccgggattcagaaaggctcagccatggctgccactactaccaccgccattttcacaaccctgaacgaacccaaaccagagacccaaaggaggggctgggccaagtccaggcagcgtcgccaagtgtggaagaggcgggcggaagatgggcagggagactccggtatctcttcacatttccaaccttggcccaagcattcccttaaacacagggtcaaaaagagtccaccggaggaaagcaaccaaaatggtggagagggctcctaccgagaagcagagacctttaactcccaagtaggactgcccatcttatacttctctgggaggcgggagcggctgctgctgcgtccagaagtgctggctgagattccccgggaggcgttcacagtggaagcctgggttaaaccggagggaggacagaacaacccagccatcatcgcaggtgtgtttgataactgctcccacactgtcagtgacaaaggctgggccctggggatccgctcagggaaggacaagggaaagcgggatgctcgcttcttcttctccctctgcaccgaccgcgtgaagaaagccaccatcttgattagccacagtcgctaccaaccaggcacatggacccatgtggcagccacttacgatggacggcacatggccctgtatgtggatggcactcaggtggctagcagtctagaccagtctggtcccctgaacagccccttcatggcatcttgccgctctttgctcctggggggagacagctctgaggatgggcactatttccgtggacacctgggcacactggttttctggtcgaccgccctgccacaaagccattttcagcacagttctcagcattcaagtggggaggaggaagcgactgacttggtcctgacagcgagctttgagcctgtgaacacagagtgggttccctttagagatgagaagtacccacgacttgaggttctccagggctttgagccagagcctgagattctgtcgcctttgcagcccccactctgtgggcaaacagtctgtgacaatgtggaattgatctcccagtacaatggatactggccccttcggggagagaaggtgatacgctaccaggtggtgaacatctgtgatgatgagggcctaaaccccattgtgagtgaggagcagattcgtctgcagcacgaggcactgaatgaggccttcagccgctacaacatcagctggcagctgagcgtccaccaggtccacaattccaccctgcgacaccgggttgtgcttgtgaactgtgagcccagcaagattggcaatgaccattgtgaccccgagtgtgagcacccactcacaggctatgatgggggtgactgccgcctgcagggccgctgctactcctggaaccgcagggatgggctctgtcacgtggagtgtaacaacatgctgaacgactttgacgacggagactgctgcgacccccaggtggctgatgtgcgcaagacctgctttgaccctgactcacccaagagggcatacatgagtgtgaaggagctgaaggaggccctgcagctgaacagtactcacttcctcaacatctactttgccagctcagtgcgggaagaccttgcaggtgctgccacctggccttgggacaaggacgctgtcactcacctgggtggcattgtcctcagcccagcatattatgggatgcctggccacaccgacaccatgatccatgaagtgggacatgttctgggactctaccatgtctttaaaggagtcagtgaaagagaatcctgcaatgacccctgcaaggagacagtgccatccatggaaacgggagacctctgtgccgacaccgcccccactcccaagagtgagctgtgccgggaaccagagcccactagtgacacctgtggcttcactcgcttcccaggggctccgttcaccaactacatgagctacacggatgataactgcactgacaacttcactcctaaccaagtggcccgaatgcattgctatttggacctagtctatcagcagtggactgaaagcagaaagcccacccccacccccattccacctatggtcatcggacagaccaacaagtccctcactatccactggctgcctcctattagtggagttgtatatgacagggcctcaggcagcttgtgtggcgcttgcactgaagatgggacctttcgtcagtatgtgcacacagcttcctcccggcgggtgtgtgactcctcaggttattggaccccagaggaggctgtggggcctcctgatgtggatcagccctgcgagccaagcttacaggcctggagccctgaggtccacctgtaccacatgaacatgacggtcccctgccccacagaaggctgtagcttggagctgctcttccaacacccggtccaagccgacaccctcaccctgtgggtcacttccttcttcatggagtcctcgcaggtcctctttgacacagagatcttgctggaaaacaaggagtcagtgcacctgggccccttagacactttctgtgacatcccactcaccatcaaactgcacgtggatgggaaggtgtcgggggtgaaagtctacacctttgatgagaggatagagattgatgcagcactcctgacttctcagccccacagtcccttgtgctctggctgcaggcctgtgaggtaccaggttctccgcgatcccccatttgccagtggtttgcccgtggtggtgacacattctcacaggaagttcacggacgtggaggtcacacctggacagatgtatcagtaccaagttctagctgaagctggaggagaactgggagaagcttcgcctcctctgaaccacattcatggagctccttattgtggagatgggaaggtgtcagagagactgggagaagagtgtgatgatggagaccttgtgagcggagatggctgctccaaggtgtgtgagctggaggaaggtttcaactgtgtaggagagccaagcctttgctacatgtatgagggagatggcatatgtgaaccttttgagagaaaaaccagcattgtagactgtggcatctacactcccaaaggatacttggatcaatgggctacccgggcttactcctctcatgaagacaagaagaagtgtcctgtttccttggtaactggagaacctcattccctaatttgcacatcataccatccagatttacccaaccaccgtcccctaactggctggtttccctgtgttgccagtgaaaatgaaactcaggatgacaggagtgaacagccagaaggtagcctgaagaaagaggatgaggtttggctcaaagtgtgtttcaatagaccaggagaggccagagcaatttttatttttttgacaactgatggcctagttcccggagagcatcagcagccgacagtgactctctacctgaccgatgtccgtggaagcaaccactctcttggaacctatggactgtcatgccagcataatccactgattatcaatgtgacccatcaccagaatgtccttttccaccataccacctcagtgctgccgaatttctcatccccacgggtcggcatctcagctgtggctctaaggacatcctcccgcattggtctttcggctcccagtaactgcatctcagaggacgaggggcagaatcatcagggacagagctgtatccatcggccctgtgggaagcaggacagctgtccgtcattgctgcttgatcatgctgatgtggtgaactgtacctctataggcccaggtctcatgaagtgtgctatcacttgtcaaaggggatttgcccttcaggccagcagtgggcagtacatcaggcccatgcagaaggaaattctgctcacatgttcttctgggcactgggaccagaatgtgagctgccttcccgtggactgcggtgttcccgacccgtctttggtgaactatgcaaacttctcctgctcagagggaaccaaatttctgaaacgctgctcaatctcttgtgtcccaccagccaagctgcaaggactgagcccatggctgacatgtcttgaagatggtctctggtctctccctgaagtctactgcaagttggagtgtgatgctccccctattattctgaatgccaacttgctcctgcctcactgcctccaggacaaccacgacgtgggcaccatctgcaaatatgaatgcaaaccagggtactatgtggcagaaagtgcagagggtaaagtcaggaacaagctcctgaagatacaatgcctggaaggtggaatctgggagcaaggcagctgcattcctgtggtgtgtgagccaccccctcctgtgtttgaaggcatgtatgaatgtaccaatggcttcagcctggacagccagtgtgtgctcaactgtaaccaggaacgtgaaaagcttcccatcctctgcactaaagagggcctgtggacccaggagtttaagttgtgtgagaatctgcaaggagaatgcccaccacccccctcagagctgaattctgtggagtacaaatgtgaacaaggatatgggattggtgcagtgtgttccccattgtgtgtaatcccccccagtgaccccgtgatgctacctgagaatatcactgctgacactctggagcactggatggaacctgtcaaagtccagagcattgtgtgcactggccggcgtcaatggcacccagaccccgtcttagtccactgcatccagtcatgtgagcccttccaagcaaatggttggtgtgacactatcaacaaccgagcctactgccactatgacgggggagactgctgctcttccacactctcctccaagaaggtcattccatttgctgctgactgtgacctggatgagtgcacctgccgggaccccaaggcagaagaaaatcagtaa

SEQ ID NO: 47 - DNA, 615 bp, Homo sapiens
  CDS (1)..(390)
atgagccatttgcagagcttattgttagacaccctcttgggaaccaagcatgtggacagtgcagccctcatcaaaatccaggagcggagcttgtgtgtagcatcaccaggtttcaatgtaacgcccagtgatgtccgaacactggtgaatggatttgccaagaaccctttgcaagcccgaagagaaggactgtatttcaagggaaaagattacagatgtgtccgggcagatgaatattctctttatgccaaaaatgagaacactggtgtggttgttgtgaagacccatctgtatcttctggtggcaacttacactgagggcatgtatcctagcatctgtgtggaagccacagagagcctgggagactacctaagaaaaaaaggaagttaagtcatcagaggcccatgaaagacacttttattattttagaagaaaattgaagagcctaaagaaaaaatattttatggttgaaaaaacactagacagaaggcactaaaaaagaagaatgaattaagggagcaatttttattacttccagagatcctcttctttcactggaattacttgatcaactgttttttaataagtgttggtcatcggcatggaaaaaaaaaa

SEQ ID NO: 48 - DNA, 885 bp, Homo sapiens
  CDS (222)..(761)
cgcctaccaaacaaagcagtctcaccaggggctgcagaaaatcccgcttcaagcgggattttttttgcccggacggcggcaaggcgaccattcgctctgtcgcatgcgttgatcaccatcagggttactgctgcgccaggtgctgtgtgcgctgcctagaatctgttgcaggcaatagatcaattgcccgtacaagcacgtacaagaggagaagcattgcaatgcaagagacgacaacagccgccgcccccagcgctcagcgcgtgatcaagaaataccccaaccgccgtctctacgacaccaacacgtcctcctacatcacgctgacggaagtcaagcagctggtaatgagcaacgagcccgtggtggtcaaggaccccaagagcggcgaagacctcacgcgcagcatcctgctgcagatcattccggaagaagaggccggcggcgcgcccatgttctccgagaccgtgctggccaacatcatccgtttctacggccatgccatgcagggctacatgggttcctacctggaaaagaacgtgcagatgttcaccgacttccagaacaagctggccgagcaggcccagggcacctcgcccgaggcttggagccagttcatgcgcatgcagccgccagccatgcagaacatgatgagcagctacatggagcagtcgcagaacatgttcacccagatgcaggaccagatgcaaaagcagaccgagcagatgctgggtgcgctcgggatcaagcgcaatagctgagcttgcagggataagttcaggggcggtttaccaagttcgcgcagaactgggacaatatcgcccctatgacccccacgagcgacgcaacaaccatgacaaccccctcgtgccaagcttggcgtaa

SEQ ID NO: 49 - DNA, 2239 bp, Homo sapiens
  CDS (598)..(2115)
ggcctttgagctcccctggactatgtcccttagggcacctggaggtccgtaggaagcaggctcgaggggggaaggcggcgcggataaaggctgagggccgcgcgcttggcccagaccggcccggccagcgcgcattcggccccggacgaaggtactcgcagcacttggagcgcagaaccggccgcgcccgatcctccgagcggcggcgacggctgttgctaagggaggggacgcgcgaggaagcgcgacccgggcggcagacggcacccagcgccaccagccgagcggcgccccctccccaggacccttaaccgcgccgcgtcccggtcgcgcccgccgccctttgaaggagaagcaagtgccgtccccacccccggaaggcgcccccaggagccggagcgacctcggagcgccactcggattttggatttcggtctcgcattccgcggccgggactttctcgaggaggacgcgcgctgctccgcgcccccgagtgcccggaggacccggcatccggggagcctctcgcccctgtcccggaggcgcggcgaggattggcggcgcccgccgcccccagccccccagcgcgcgccggggatggagccgcagcccggcggcgcccggagctgccggcgcggggcccccggcggcgcctgcgagctgggcccggcggccgaggcggcgcccatgagcctcgctatccacagcaccacgggcacccgctacgacctggccgtgccgcccgacgagacggtggaggggctgcgcaagcggttgtcccagcgcctcaaagtgcccaaggagcgcctggctcttctccacaaagacacccggctcagttcggggaagctgcaggagttcggcgtgggtgatggcagcaagctgaccttggtacccaccgtggaagcgggcctcatgtctcaggcctcaaggccggaacagtccgtgatgcaagctctcgagagtctcacggagacgcaggtcagtgacttcctgtcgggccgttcgccactgacactggccttgcgtgtgggcgaccacatgatgttcgtgcagctgcagctcgcggcccagcacgctccactgcaacaccgccatgtgctggccgctgcggccgccgccgctgctgcgcggggggaccccagcatagcctcccccgtgtcctcgccctgccggccggtgtccagtgccgcccgagtccccccggtgcccaccagcccgtcccctgcatctccctcgcccatcacagccggctccttccggtcccacgcagcctccaccacctgcccggagcagatggactgctcccccacggccagcagcagtgccagtcctggtgccagcaccacgtctaccccaggggccagccctgccccccgctcccgaaaacccggcgccgtcatcgagagctttgtgaatcacgccccgggggtcttctcagggaccttctctgcccacatgtccacgccattgcctgagctcatgagctcacacccgtggacgcccgtcctggacatgcgggactgtgcccgtgccgggcactcacggccacctctgcccgcaggcacgctacaccccaactgccaagacagcagcgggcggccgcggcgtgacatcggcaccatcctgcagatcctgaacgacctcctgagcgccacccggcactaccagggcatgcccccttcgctggcccagctccgctgccacgcccagtgctccccggcctcaccggcccccgacctggcccccagaactacctcctgcgagaagctcacggctgccccctcagcctccctgctgcagggccagagccagatccgcatgtgcaagcccccgggggatcggcttcggcagacagaaaaccgcgccacgcgctgcaaggtggaacggctgcagctgcttctgcagcagaaacggctccgtagaaaggcccggcgggacgcgcggggtccgtaccactggtcacccagccgcaaggccggccgcagcgacagcagtagcagcgggggcggcggcagccccagcgaggcctccggcttgggcctcgacttcgaggactccgtgtggaagccagaagtcaaccctgacatcaagtcagagttcgtggtggcttaggatcttcggatcggccaccctcgcccctcgcaccccagcccagggcggcggggactccgagagcccggagagaacgtggccccagccctggagggcagggcggccactcccccagccagaagtc

SEQ ID NO: 50 - DNA, 2189 bp, Homo sapiens
  CDS (144)..(2114)
gggtctgtgaagaccatgctgacctgagcctggcaagatggtacaggggttcaacaatcccctgccacatccttcttcaggctctgctaattcagccgtgtccctctccctctgcccgttcccctacaggacacttcacggccatggtatggaagaacaccaagaagatgggcgtggggaaggcgtccgcaagtgacgggtcctcctttgtggtggccagatacttcccagcggggaatgttgtcaatgagggcttcttcgaagaaaacgtcctgccgccgaagaagcctgagaaagtctgctctccagtacctgctgctgatctgtttcagccgacaagaggcaccatgaaattggaattcacggagaaaaactacaatagcttcgtgctgcagaacctgaacagacagaggaaacgcaaagagtactgggacatggccctgagtgtggacaaccacgtcttctttgcacatcgcaatgtgctggctgctgtctccccactggtgaggagcctcatctccagcaatgacatgaagaccgctgatgagcttttcatcaccattgacaccagttacctgagcccggtcacagtggaccagcttctggactacttctatagcggcaaggtggtgatctccgagcaaaatgtggaggagctgcttcgtggggctcagtatttcaacacaccacgccttcgagttcactgtaacgacttccttattaagtccatctgccgtgccaactgcttgcgctacctcttcttggctgagctgtttgagctcaaagaggtatcagacgtagcttactctggcattcgggacaacttccactactgggccagtcctgagggctccatgcacttcatgcgctgtccacctgttatctttggccgcctgctccgtgatgaaaaccttcacgtgctcaatgaagaccaggcgctcagcgcactcatcaattgggtgtacttccggaaggaggatcgggagaagtatttcaagaagttcttcaattacatcaatctcaatgctgtctccaataagacgctggtgtttgccagcaacaagctggtgggcatggagaacacctcatcccatacaaccctgattgagagtgtcctgatggaccgcaagcaggagcggccatgcagcctgctggtctaccagcggaaaggggccctgcttgattccgtggtcatcctcggtggccagaaggcccacggccagttcaatgatggagtgtttgcttatatcatccaggagaacctgtggatgaagctttcagacatgccctatcgggcagcagcacttagtgccacctctgctggtcgctacatctacatctctggtggcaccactgagcagatttcagggctgaagacagcctggcggtatgacatggatgacaactcctggaccaagttgcctgacctgcccatcgggcttgtcttccacaccatggtgacctgtggggggacagtgtactcagtgggcgggagcattgccccaaggcggtatgtctccaacatctatcgctatgatgagcggaaggaagtctggtgcctggcaggaaagatgagcatccccatggatggcaccgccgtgatcactaaaggagacaggcatctgtacattgtcactggacggtgcttggtgaaaggttatatctcccgggtcggggtagtggactgctttgacaccagcactggggacgtggtccagtgtatcaccttccccattgagttcaaccatcggcccctgctctctttccaacaggacaacatcctctgcgtgcacagccaccggcagagtgtggaaatcaatctgcagaaggtgaaggcaagcaagacgaccacctcagtgcctgtcttgcccaacagctgccccttggatgtgtcccatgctatatgctccattggagacagcaaggtgtttgtatgtgggggtgtcaccactgccagcgatgtccagacaaaggactacaccatcaatccaaatgccttcttgctggaccaaaagacaggcaagtggaagaccctggctcctccaccagaggcactggactgtcctgcctgctgtctagccaagctaccttgcaagattcttcaaaggatttaaacattttaagtgggagaataagtaaatgcattattattcacgatttaatgagagaaagagaggaaaaaaaaaaaa

SEQ ID NO: 51 - DNA, 1313 bp, Homo sapiens
  CDS (6)..(1313)
caaccatgcaaggacagggcaggagaagaggaacctgcaaagacatattttgttccaaaatggcatcttacctttatggagtactctttgctgttggcctctgtgctccaatctactgtgtgtccccggccaatgcccccagtgcatacccccgcccttcctccacaaagagcacccctgcctcacaggtgtattccctcaacaccgactttgccttccgcctataccgcaggctggttttggagaccccgagtcagaacatcttcttctcccctgtgagtgtctccacttccctggccatgctctcccttggggcccactcagtcaccaagacccagattctccagggcctgggcttcaacctcacacacacaccagagtctgccatccaccagggcttccagcacctggttcactcactgactgttcccagcaaagacctgaccttgaagatgggaagtgccctcttcgtcaagaaggagctgcagctgcaggcaaatttcttgggcaatgtcaagaggctgtatgaagcagaagtcttttctacagatttctccaacccctccattgcccaggcgaggatcaacagccatgtgaaaaagaagacccaagggaaggttgtagacataatccaaggccttgaccttctgacggccatggttctggtgaaccacattttctttaaagccaagtgggagaagccctttcaccctgaatatacaagaaagaacttcccattcctggtgggcgagcaggtcactgtgcatgtccccatgatgcaccagaaagagcagttcgcttttggggtggatacagagctgaactgctttgtgctgcagatggattacaagggagatgccgtggccttctttgtcctccctagcaagggcaagatgaggcaactggaacaggccttgtcagccagaacactgagaaagtggagccactcactccagaaaaggtggatagaggtgttcatccccagattttccatttctgcctcctacaatctggaaaccatcctcccgaagatgggcatccaaaatgtctttgacaaaaatgctgatttttctggaattgcaaagagagactccctgcaggtttctaaagcaacccacaaggctgtgctggatgtcagtgaagagggcactgaggccacagcagctaccaccaccaagttcatagtccgatcgaaggatggcccctcttacttcactgtctccttcaataggaccttcctgatgatgattacaaataaagccacagacggtattctctttctagggaaagtggaaaatcccactaaatcctag

SEQ ID NO: 52 - DNA, 1881 bp, Homo sapiens
  CDS (2)..(1825)
gatggccgagaagcgaaggggctcgccgtgcagcatgctaagcctcaaggcgcacgctttctcggtggaggcgctgatcggcgccgagaagcagcaacagcttcagaagaagcggcgaaaactgggcgccgaagaggcggcgggggccgtggacgacggaggctgcagccgcggcggcggcgcgggcgaaaagggttcttctgagggagacgaaggcgctgcgctcccgccgccggctggggcgacgtctgggccggctcggagtggcgcagacctggagcgcggagccgcgggcggctgtgaggacggcttccagcagggagcttcccctctggcgtcaccgggaggctcccccaaggggtctccggcgcgctccctggcccggcccgggacccctctgccctcgccgcaggccccgcgggtggatctgcagggagccgagctctggaagcgctttcatgagataggcactgagatgatcatcaccaaggccggcaggcgcatgtttccagcaatgagagtgaagatctctggattagatcctcaccagcaatattacattgccatggatattgtaccagtggacaacaaaagatacaggtatgtttaccacagttcgaaatggatggtggcaggtaatgctgactcgcctgtgccaccccgtgtgtacattcatccagactcgcctgcctcgggggagacttggatgagacaagttatcagcttcgacaagctgaagctcaccaacaatgaactggatgaccaaggccatattattcttcattctatgcacaaataccaaccgcgagtgcacgtcatccgtaaagactgtggagacgatctttctcccatcaagcctgttccatccggggagggagtaaaggcattctcctttccagaaactgtcttcacaaccgtcactgcctatcagaatcagcagattactcgcctgaagatagataggaatccatttgctaaaggcttccgagactccgggcgcaacagaatgggtttggaagccttggtggaatcatatgcattctggcgaccatcactacggactctgacctttgaagatatccctggaattcccaagcaaggcaatgcaagttcctccaccttgctccaaggtactgggaatggcgttcctgccactcaccctcaccttttgtctggctcctcttgctcctctcctgccttccatctggggcccaacaccagccagctgtgtagtctggcccctgctgactattctgcctgtgcccgctcaggcctcaccctcaaccgatacagcacatctttggcagagacctacaacaggctcaccaaccaggctggtgagacctttgccccgcccaggactccctcctatgtgggcgtgagcagcagcacctccgtgaacatgtccatgggtggcactgatggggacaccttcagctgcccacagaccagcttatccatgcagatttcgggaatgtccccccagctccagtatatcatgccatcaccctccagcaatgccttcgccactaaccagacccatcagggttcctataatacttttagattacacagcccctgtgcactatatggatataacttctccacatcccccaaactggctgccagtcctgagaaaattgtttcttcccaaggaagtttcttggggtcctcaccgagtgggaccatgacggatcggcagatgttgccccctgtggaaggagtgcacctgcttagcagtgggggtcagcagagtttctttgactctaggaccctaggaagcttaactctgtcatcatctcaagtatctgcacatatggtctgatgaagcccttaagttaaatgacatttggatctgtctaacatattttctttttcttg

SEQ ID NO: 53 - DNA, 959 bp, Homo sapiens
  CDS (114)..(557)
ccagccaactgtaggactaatcccttcaagcttactcccccgctgccctctcctcttctgccaacgtgcccactgacagaaaccaaccagcagcaaaagacagcctccaactaatgccactgaagacattcccagctgctatccggggagtcatccagagtgagctcaactattctgtgatcctgcagtgggtggtgacaatggaccctgagcctgtgctgagctggaccttcagtggggtgccctgtgggatgggagagaagctgttcatccgacggttgtcctgtgagcagctgggcacctacatgtgcatagccacaaacagcaagaaacagctggtctctgagcctgtaaccatctcgctgccaaaacccatcatgcagcccacagaagcagagcccatggagccagaccccactctgtccctgtcaggaggctctgccatcgggctccttgcggctgggatcctgggagccggggcactgattgcaggcatgtgtttcatcatcatccagagcctaaggactgacaggcagagaataggaatatgcagctgaaatgtgggcaactctcctgtcagctgaagagatgggtgctttgtacctctctatccacgtggaaaaaaaaacccatcccatagcttccaagtctacaacatctctgttcaagggaacaacccaacgtaaccagactccctttgccctgtttctgaaacacctgaagaaaacatctgatgggttgactcggtgccatccttggtcccatcgccgtgacacgttgtgcaagcaaagcatcagaggttcatccctgtctgtgggagctcagtgctcagaaaacaggggggaggttttaccttggaaattggccagaccccaaaatatgtcttttacacatgctgctttttttttctctttttcaaaaagaaccaaaaaataaattaaaacaccaaaaaaaaaaaa

SEQ ID NO: 54 - DNA, 1746 bp, Homo sapiens
  CDS (1)..(1104)
atgatgcctagtgtcatgaaagcaggacgccagaactgtagcgttaccagcagcaggcaatgcctacctgggaaaccctcagaaacctatagaggcagtgttgtgtggagtacacagcaaagccatagggttcgttatgtaccagcaaatgttcatggtactgaagatataccagttgaagagaaagaatgttcttgttgtcatagtacctatttgctacgagaaggtgaaggagcctatgaagatcaacaaggagaatttccaagagtcatgtcagcctccagtatcacctcaacacatccaacttccttcttgttgatggggattccaggcctggagcacctgcacatctggatctccatccccttctcagcatatacactggccctgcttggaaactgcaccctccttctcatcatccaggctgatgcagccctccatgagcccatatacctctttctggccatgttggcagccatcgacctggtcctttcctcctcagcattgcccaaaatgcttgccatattctggttcagggatcgggagatcaacttttttgcctgtctggtccagatgttcttccttcactccttctccatcatggagtcagcagtgctgctggccatggcctttgaccgctatgtggccatctgcaagccactgcactacaccacggtcctgactgggtccctcatcaccaagattggcatggctgctgtggcccgggctgtgacactaatgactccactccccttcctgctgagatgtttccactactgccgaggcccagtgattgcccgctgctactgtgaacacatggctgtggcagttctacaactctcctctcaggaggcccgctacaaagcatttgggacatgtgtctctcacataggtgccatcttagccttctacacaccttcagtcatctcttcagtcatgcaccgtgtggcccgctgtgctgcgccacacgtccacattctcctcgccaatttctatctgctcttcccacccatggtcaatcccatcatctacggcgttaagaccaagcagatccgtgacagtcttgggagtattcccgagaaaggatgtgtgaatagagagtgaggaataagtggaaaaagagtggggcacagtgaatgctgtagtgggccagggctgtgctgagagtagatgggtcctagactccacgtttagttcttttcttgtattatgaaaagaataaatgatgtcctgaagctcagtgccaacagtctgtttagaatttgtgggtctttgccctctggtagcctctggattgaacctggtgactgtgctgtctcctcacagagccctgactcctgtcagtaaacttgacagagtcttgaccctccggcctcatggtgactttgctgaaggacacaaagatgcttccaagttcatttgcctaagagaagactgtgaaaatctgaatttccatctctgacttgttggaaatttggtgaattatccactcagattcccgagttaggacctctactccatccagtgcaggagttctgctacattctaacagttgatccctagactctacctaaacactgtcagtgctggtgcacatgcatcctttaggcctatttattccaagtgagacagctctgcttgttaaaaggttatttcttcaattaagccagtctgtattctttgacttctttttacctcctcatcctcatggctattccatctcattaaatactttgaaaaaaaaaa

SEQ ID NO: 55 - DNA, 1118 bp, Homo sapiens
  CDS (96)..(644)
  misc_feature (1)...(1118): n = a,t,c or g
agcttcttctccgaaccaaccctttgccttcggacttctccggggccagcagccgcccgagcaggggcccggggccacgggctcagccgacgaccatgggctccgtgtccaaccagcagtttgcaggtggctgcgccaaggcggcagaagaggcgcccgaggaggcgccggaggacgcggcccgggcggcggacgagcctcagctgctgcacggtgcgggcatctgtaagtggttcaacgtgcgcatggggttcggcttcctgtccatgaccgcccgcgccggggtcgcgctcgaccccccagtggatgtctttgtgcaccagagtaagctgcacatggaagggttccggagcttgaaggagggtgaggcagtggagttcacctttaagaagtcagccaagggtctggaatccatccgtgtcaccggacctggtggagtattctgtattgggagtgagaggcggccaaaaggaaagagcatgcagaagcgcagatcaaaaggagacaggtgctacaactgtggaggtctagatcatcatgccaaggaatgcaagctgccaccccagcccaagaagtgccacttctgccagagcatcagccatatggtagcctcatgtccgctgaagggcccagcagggccctagtgcacagggaaagccaacctactttcgagaggaagaacgaagaatccacagccctaccctgctcccggaggcaccagaattgagccacatgggtggggggtaatcttgtgctatcaggaagtttcgaggagcaggcagattggcgaactgtggcatacggctgattgcgggctattgggactgcccagtttcacagctgggttacaacattcacctttttccttaggtggtcgggaacttgggtgcggcacagcacgtcctccaccaagtcgtgaacaacgcaaagaagagtgtgagaccccgcgggggggaccccccacacggcaatgggcgcaacacaaaatacgttgagaggctggtgcacaggcgactacacgtgtaaacagcccaagaaatcatatcgacatacagaagtggcagacataggaagctatccatgccagagacacgatgaccccacatcagctgttntga

SEQ ID NO: 56 - DNA, 615 bp, Homo sapiens
  CDS (1)..(615)
atgaagaagctactagcaatgattctgtggcttcaactagaccggttaagtggagagctgaaagtggaacaaaaccctctgttcctgagcatgcaggagggaaaaaactataccatctactgcaattattcaaccacttcagacagactgtattggtacaggcaggatcctgggaaaagtctggaatctctgtttgtgttgctatcaaatggagcagtgaagcaggagggacgattaatggcctcacttgataccaaagcccgtctcagcaccctccacatcacagctgccgtgcatgacctctctgccacctacttctgtgccgtggacacacagtgctcccctgacgccaccagtctgtacccaaacctgcagctgtcttactctggctgccgtgctgagaatagactgcagatcatcaagatgaaagtggggaaaattgttgtattaacattaaaaccaaagatatctggtgttactctgagctcagaggcttcttccaccagaaaagctcattcaagagcagctgttgttactgctcctgctgatggaagaggggctaaagacatatttgatagcctttctgtagatctcttgactgcagatgacctgtga

SEQ ID NO: 57 - DNA, 2537 bp, Homo sapiens
  CDS (74)..(1570)
cggacgcgtggggcactctcctgactcaaaacgatcttctaaactccagccagtaacagaagtgaaaactcatatgcagcatggattaatctctatagcagcccgcactgttattacacatctggtaaatcacctgggccattatccaatgagcggtggtcctgctatgctaacaagtcaggtgtgtgaaaatcacgacaatcattacagtgaaagtactgaactttctcctgaactctttgagagtccaaatatccagttctttgtgttaaataatacaaccttagtgtcctgtatccagatcagatcagaagagaatatgcctggaggaggtttatctgctggccttgcatcagccaattcaaatgtcagaatcatagtacgtgatctctctggaaaatattcatgggattctgctatactgtatggcccacctccttttaaaagatttagagaaactgtaccaacttgggatacaataagagatgaagaagatgctcttgatgaactcttgcagtatttgggtgttactagtcctgaatgcttacagagaactggaatctcacttaatattcctgctccacaacctgtgtgcatttctgaaaaacaagaaagtgatgttattaatgctatccttaagcaacatacagaagaaaaagaatttgttgagaagcactttaatgacttaaacatgaaagctgtggaacaagatgaaccaatacctcaaaaacctcagtcagcattttattattgcagattgcttcttagtatattgggaatgaattcctgggacaaacggaggagctttcatctcctgaagaaaaatgaaaagctacttagagaacttaggaacttggattcaaggcagtgccgagagacacacaagattgcagtattttatgttgctgaaggacaagaagacaaacactccattctcaccaatacaggaggaagtcaagcatatgaagattttgtagctggtcttggttgggaggtaaatcttacaaaccattgtggttttatgggaggactacaaaaaaacaaaagcactggattgaccactccatattttgctacctctacagtagaagtaatatttcacatgtcaacaagaatgccttctgattctgatgattctttgaccaaaaaattgagacatttgggaaatgatgaagtgcacattgtttggtcagagcatactagagactacaggagaggaattattcccacagaatttggtgatgtccttattgtaatatatccaatgaaaaatcacatgttcagtattcagataatgagaaaaccagaggttcccttctttggtcccctttttgatggtgctattgtgaatggaaaggttctacccattatggttagagcaacagctataaatgcaagccgtgctctgaaatctctgattccattgtatcaaaacttctatgaggagagagcacgatacctgcaaacaattgtccagcaccacttagaaccaacaacatttgaagattttgcagcacaggttttttctccagctccctaccaccatttaccatctgatgccgatcattaaatatcagttctgtttatctgaaggctcctacccagagattctacccagtgaaactcccacagcaacgcaggtagatggggctgacctggcctctccaatgtctcctcgaactagcaaaagccgcatgtccatgaagctgcgtcgttcctctggctcagccaataaatcctaaggagacaagcagcccagcagtgatcagcagtagccaccttagcacgaacatagggttaaccctttcaggccttcatgtctgccataacatgcatgtttcttcctgtacatttatttgagaaaacactggatttaaataattttaaataatttgtagcttaatattaaagatttaagttatttattgtttcatttttttcccacaatccaagctgccatattttgagggcagggggagttttattctacaccctttaccttcctagataattatgtctaagtagttttatctttaatttcatggttaactgtgagccaaaatacaattggacaattagtctcattatttattgtgctccattgcaactttatggttcaataaatatataattttttacaaatgtaaaattttacatttaagcatttgtaaagttacagcaaaagatgtacctgttaatacacagaatgtgtacagattatttgttatgacaataaaacactcaaaataaatggtctttagcatctcaaattccaactgaaatcattttagtattaactcttcttcccaaagcaatgtctcatttcttggctgtgcaggtgatgccatgttatatccaataactagaaaaatcactgtgctgaacttttatgtttagcttccaagtatttttctaatgttttgcatttcaagtggtatcactgttaaatgccatttgttttcagattgtggccttttattattggctgctagatcctggtgtttctatgttcttttttaagcaccaaaaaaaaaaaa

SEQ ID NO: 58 - DNA, 1601 bp, Homo sapiens
  CDS (54)..(1601)
tttgtgaaaaattttaatctcagtactgtgaagaagctggaaaaagggatattatggggctaaaagctctctgtttggggctgctttgtgttctttttgtctctcatttttacacacccatgccagacaacattgaagaaagctggaaaataatggccttggatgccatcgctaaaacttgtacatttacggctatgtgttttgaaaatatgcgtattatgagatatgaagagtttatatccatgatattcaggctggattatacccaaccactttcagatgaatacatcacagtgactgatacaacatttgttgacattccagtacgattgtacttgccaaaaagaaagtcagaaacccgaaggcgagctgtgatatattttcatggtggtggtttttgttttggaagttccaaacagagggcttttgacttcctgaatagatggacggcaaacacgcttgatgctgttgttgtaggcgtggactataggctggctcctcaacaccactttcctgctcagtttgaagatggccttgctgcagtcaaattttttcttttggaaaaaattcttacaaaatatggagtggatcccacccgaatctgcattgcgggagacagttctgggggcaatttagcaacagcggtcactcaacaggtgcagaatgatgctgaaataaaacataaaatcaagatgcaagtcttactttaccctggcttacagataacagattcttatttgccatctcaccgagaaaatgagcatggtatagttttgaccagggatgtagccataaaactcgtgagcttatatttcaccaaggatgaagcacttccctgggcaatgagaagaaaccaacacatgcctctggagtcaagacatctgtttaagtttgttaactggagtattcttcttcctgagaagtatagaaaagactatgtatatactgaaccaattcttggaggacttagttattcattgccaggacttacagacagcagagcattacccttgttggccaatgattctcagttacagaatttgccactaacctatattcttacttgtcaacatgatctcttaagagatgatggacttatgtatgttacaagacttcgaaatgttggagtccaagttgttcatgaacatattgaggatggaattcatggagctttatcattcatgacttcaccattttatttacgtctaggtcttaggataagagatatgtatgctttgttagttgaactcttgggaatcaatcatttcatgaatactgcaacgttctttgtgagctttcaagaagtcccacctacatctgatgaaaatgtcaccatgatagagacaactttcagtaacattcctgtccgtgtatacatgccaacactaaagtcagagatactaagaacgggcttagtttatattcatggtggtggttggtgtatgggggatgctgatcaatttgaagatgtatataatgcactaagatggttgttatgccaagatattcttgaaaaatatcgtagagagcctaaaagaattggcatttctggagacactgctggtggaaatttagctgcagcagtgacccaactggtatga

SEQ ID NO: 59 - DNA, 629 bp, Homo sapiens
  CDS (71)..(508)
caccctcctaacagtgcatacggccaacaggattattcactcactctacaattcatgtagtctattctctatggtgggctccgtgctaggcactaaggatttagtggtgaacaagaccaagatgtggaccctgccctactggagcccacaatctgattgggaagatagaaagttaacaatagtgatgtccagcaaggtggccatcaacagtgacattgggcaggccctctgggcagtggagcagctccagatggaggcaggcatcgaccaagtgaaggtgagggtcggggccagtgcaggaggcgggaagaggtgggaacacatgggccaggggacaggtgcatgcctgggtctggtctggctgaaccagttggtctgcaggtgtccaaagatggccgccgatctgctgaagttctgcacggagcaggccaagaatgaccccttccttgtgggcatcccggccgccaccaactccttcaaggagaagaagccctatgccatcctatgaacccagggcaatgcaccctgtggcctgggcaaaccagggggcctcaataaacatgaagtgaataccttctcagggcatggctgagctgggctgagatgtcgaccggccgcgaatttagtag

SEQ ID NO: 60 - DNA, 1143 bp, Homo sapiens
  CDS (1)..(1143)
atggagttcacggcgtcccccaagccccaactctcctcccgggccaacgccttctccattgccgcgctcatgtcgagcggcggctctaaggagaaggaggcgacggagaacacaatcaaacccctggagcaatttgtggagaagtcgtcctgtgcccagcccctgggtgagctgaccagcctggatgctcatggggagtttggtggaggcagtggcagcagcccgtcctcctcctctctgtgcactgagccactgatccccaccacccccatcatccccagtgaggaaatggccaaaattgcctgcagcctggagaccaaggagctttgggacaaattccatgagctgggcaccgagatgatcatcaccaagtcgggcaggaggatgtttccaaccatccgggtgtccttttcgggggtggatcctgaggccaagtacatagtcctgatggacatcgtccctgtggacaacaagaggtaccgctacgcctaccaccggtcctcctggctggtggctggcaaggccgacccgccgttgccagccaggctctatgtgcatccagattctccttttaccggtgagcaactactcaaacagatggtgtcttttgaaaaggtgaaactcaccaacaatgaactggatcaacatggccatataattttgaactcaatgcataagtaccagccaagggtgcacatcattaagaagaaagaccacacagcctcattgctcaacctgaagtctgaagaatttagaactttcatctttccagaaacagtttttacggcagtcactgcctaccagaatcaactgcgtaagcttaaggggctgtggcagtactacactccacagataacgaagctgaaaatagatagcaatccttttgccaaaggattccgggattcctccaggctcactgacattgagagactccagctgtgtggcaacctgttccccaaagaactgctcaaagatctgctttcatctttaaccccatttgctccaagttggggttttgatgaagttccaacagaagccttgtttatttccaccccgggtatctttcttccttatgtgctgatggatggcatgccggctggtgctgcccttactccttacctgtctgtggctgaaatattttaa

SEQ ID NO: 61 - DNA, 813 bp, Homo sapiens
  CDS (1)..(813)
atgacaagaacttatgaagtaaagtttggcctttgtgtatggaagaggaatggaggatgtcgggatgcaggtcaaggaaggcatcctgtggaagtgacatttgagctaatatctgaagaatgggtgacaggaagaaaaagaatgcttcagagaacagcaggtacagaagctgaggttgaaaaggtggatgtgtccagggaagaggacagcaccgacgtctataataccaggggtcgggttaccatggatcaggagttgtccaaagagcagaaagtattttttaaaacggtgcaacatttacttaaggttattcagtgcaccatagagtctgaagctttgcataagcttatgtttttaattcggcaggaatgcccttggttccctgaccaaggaacattagacttagagttatgggagcaggcagattgctgcctgaaaagaggatttgagcaggtccattttactaatgttaccgttttgatcacctggagtctggcatgttctgtgttgtaccctctttatatgccagatcgtggtgagtcagattgcccattttcttcacctgaagggaattcggaaaatttaaaggaaaaggggacacagaaagcagaacaacaggaaggagttcctcccccaacttcactcccttcagtagggcataaagaagacactttttctagtgatgatgaggacggactggagccttttcctctctcaatagaaaagccattgccctcttttcctccacccttcacacgacctgcatctgttggccccattcaggcaatagcacctcccatcccccttgagtag

SEQ ID NO: 62 - DNA, 681 bp, Homo sapiens
  CDS (350)..(679)
ctgccaaaaatagcagtgcccgtgagagcccccagtaacaaaaaatttccgggctgtgtgcctaatagggttacagacacagcacactactttagacaggggctctctcgcgcgccgtcctttattttcgcacatgtgtttcccatctcattcaatatgtggatgacatttttgtttgcagcccctcttaccaatcctcccagcaagacactatcctgcttcttcaacacctctactccaaggggtacagagtatccccctccaaagctcaaatttctacttatcttggtataatcctccaccaacataggtgtgcacttccagcagaccgtattcagctaatctccaaatgccaatccccaccaccaaacaactactcctctccttcttagacgttgttggatacttctgcctttggataccaggttttgccatcctaaccaaaccactctataaactcacaaaaggaaacttagctgaacccacagatcctaaatccttccctcgcccctccttttactctaaaaaaggccctagaggcaaacccttactcaagcgcttcccgactcctcccaaccttccttcctctccacacagcaaaaacgcagggctgcgctgtaggaattcttactcaggaaccaggcctgtgaccagtagcctttgtattcaaacagcttaatc

SEQ ID NO: 63 - DNA, 464 bp, Homo sapiens
  CDS (120)..(254)
gcacgagccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggttcagtatctgaacacttttgctaaaggtctctggaaagctccctgtgttaattctcgatgagactacgtctgtgccggccgcttcctgagcctccttccatgtgcataggcctgctgcatgctggagacctgcggcacagctgccaagtgccccgtgtggttctgtgatcttgggacagtcacttcctctctgtggttgtcagtcttctcatccctaaggtatatccaagtttataattgtcctattttctatcttcccgatgttgcaaag

SEQ ID NO: 64 - DNA, 405 bp, Homo sapiens
  CDS (79)..(363)
gtggaaattgcactggcttatttgtagtttttttttaagctacaaaactaagaacaaattttagtttattgaaactaaatgactggcaagagaggaagaatgagcagttcctatgccatgaagacctttgccctggtcctgctgatggccctgctgtgcatgaagagagctcagggtctgcactgctacaggtgcttggcagtctcggaaaggaactcctgccgtgtggtcatgggcctcttccaggaggggatctgtgtctcccagaaagtaagcacctttcaggagatgaggtcttgctttgttggcatttatcttgcttggtgttctctgagcttcctggatctgtggtttggtgtctgacatgaatttggggaaattctcagtcattattgtttcaaacat

SEQ ID NO: 65 - DNA, 579 bp, Homo sapiens
  CDS (1)..(453)
atggcagagcaaaagcaaagaaaaatccctttggttccagaaaatctcctgaaaaagaggaaggcttatcaagtcctcaaagccactcagacaaagcaggcacttttggcaaagaaggagcagcggaaaggaaaagggctcagcaaaaggattgttggcgtgagtctactggtgcagacagccattgcaagacttcatcttaagaaaatttttagtggtgtctttgtaaaagtcaccccccagaacctaaaaatgctgcgtatagtggaacctaatgtgatctggggatttccaaatctgaagtctgtccgggaattcattctgaaacatggacaagccaaggtcaataagaacaccatccctctgacagacaacacagtgattgaggagcacctggggaagtttggtgtcatttgcttggaagacctcattcatgaaattgcctcccagtgaagcatttccaggagatctcatggttcttttgccctttccacctctcagtggtccatcatgctaccaaaaatacagtgggcttcctcaaggagatgggcacatacgaaatcgtcgacccgaggaatt

SEQ ID NO: 66 - DNA, 1797 bp, Homo sapiens
  CDS (502)..(1797)
atgcaggtatattctgagaaagggaataagccatgtataaaaagagatttcaccctactcaataaaactgtggttcttatagatgaagtaggtatcatcctgcacatctcagctttcggctgcaaatgggcttctgaaaaaagctccgagaggaatccaggagggagggaagctctgagcgaggacgacgaggcgatttatgcaacagtatcctgtttcagcactgccaaggctatgcgagaacgcggccaggacagcctggcaggactcgtgctgtatgtaggactcttcgggcaccccgggatgctgcacagggccaagtacagccgctttcggaacgagtcgatcacgtccttggacgaaggtagctccggaggctcggtcgggaacaagggctcgccgcagcctccccaccccgccctggcacctcacctgccgactgaagatgccaccttgccgtcgcaggagagccccaccccactgtgcaccttgatcccccgcatggcaagcatgaagctggccaacccggccactttgctgagtctgaaaaacttttgcctgggtaccaaagaggtgcctcggctgaagctccaggaaagccgggacccaggttccagcggcccctcttccccagaaaccagtttaagtaggtccgggactgcacctccaccgcagcaggacctggtgggacacagggcaaccgccctaacccctgattcgtgcccgcttcctggccctggggagccaacacttaggagcaggcaggacaggcactttctacagcacctgttggggatgggcatgaactactgtgtgaggtgggcagcagcagcttccgagatgtcctgggcaccagcatgggtctgtgtggaggctatgcggggccagcgtatgggaggcatcacagccgtcacagtcaaccagaacgtgctgagcccccttaacctggaagtggaccccaacatgcagggcatgcacacccaggagaaagagcaggtcaagaccctcaacaagtctgcctccttcgttgacaaggtactgttcctggaacagcagaacaagatgctggagaccaactggagcctcctgcagcagcagaagccggctcagagcaacatggacaacatgttcgagagctacatcaacaaccttctggggcagctagagatcctgggccaggagaagctgaaactggaggcagagcttggcaacatgcaggggctctgcatgtttttcgtgaaggaggacttcaagaaaaagtacgaggacgagatcaataagcctacagagatggagaatgaatttgtcctcatcaagaaggatgtggatgacgcttacatgaacaaggtagagctagagtttcgcctggaggggctgactgacgagatcaacttcctcaggcagctgtatgaagaggagatcccagagctgcagtcccagatcttggacacatctgtggtgctgtccatggacaacagccgctccctggacatggacagcatcatcgcggagatcaagtatgaggagctgcagacactggctgggaagcactgggatgaccggcgtcttacaaagacgaagatttctgagatgaaccggaacatcagccggctccaggctgagattgagggcctgcctcaaaggccagagcagagagcttccctggagtccgtcatcgcagatgctgagcagcggggggagctggccattaaggacgccaagactaagctgtccgagctggaggccgcccagcagcgggccaagcaggacatggcacatggcacggcagctgcctga

SEQ ID NO: 67 - DNA, 756 bp, Homo sapiens
  CDS (78)..(455)
tctcgtcttcctctgcgccccgcgtccccgccctcgcgaccccggctctcctggactcggcgccgccaacctgggcgatgccccgctacgagttggctttgattctgaaagccatgcggcggccagagaccgctgctgctttgaaacgtacaatagaatccctgatggaccgaggagccatagtgaggaacttggaaagcctgggtgagcgtgcgctcccctacaggatctcgagtcacagccagcagcacagccgaggagggtatttcctggtggatttttatgctccgacaagtgctgtggagaacatactggaacacttggcgcgagacattgacgtggttagaccaaatattgtgaaacaccctctgacccaggaagtaaaagagtgtgacggcatagtcccagtcccacttgaagaaaaactgtattcaacaaagaggaggaagaagtgagaagattcaccagattctggccttatatttaatcctaagggcactatgggtgctgctaggttgttgtctaggatactttagcccatgaccattttgctgcaggaggtagaaactgctggccgagacctgccctgatgtctctgctgagatttcatcccacttgtggggtttgtcgggagtgggggtgttcacagtaccactgtagcgtttccaagagcaaaatgtttgtcattcacacttggttgtcttgcaagcctatatggaacactgggagcagagtaataaacatgactttatcaac

SEQ ID NO: 68 - DNA, 1662 bp, Homo sapiens
  CDS (158)..(1288)
cgcctgcacctgaattcccgggtcgacgatttcgtgcccgccggccaagcgagcgcgggccggggccggggccggggcctgggggcgccgcccccgggagtctttctgcggcccctgaggagcgagggcgacggcgaggctgaccggggccgaaaccatgaaccgaagttttcacaagtctcagaccttgcgattctacgattgcagcgcagtggaagtcaagagcaagtttggggcggaattccgaaggttctctctggaccgtcataagcctgggaagtttgaagatttctacaagctggttgtgcacacccaccatatctccaacagtgatgtaactattggctatgcagatgtgcacggagacctgctgcccatcaacaatgatgacaacttctgcaaggcggtttctagtgcaaatcccctgctcagggtcttcatccagaaacgagaggaggccgagcgtggcagcctcggcgcgggctcgctgtgcaggcggaggcgggcgctgggcgcgctgcgtgatgaaggaccccggcggcgtgcacacctggacatcggcctcccgcgcgacttccgccccgtatcatccatcatcgatgtggacctggtccccgagacgcaccggcgagtgcggctgcaccggcacggctgcgagaagccgctgggcttctacatccgcgatggcgccagcgtgcgcgtgaccccgcacgggctggagaaggtgcccggcatcttcatctcgcgcatggtacccgggggcctggcggagagcaccgggctgctggctgtgaatgacgaggtcctggaggtgaacggcattgaggtggccgggaagacgctggaccaggtcacggacatgatgatcgccaacagccacaacctcatcgtcaccgtcaagcccgccaaccagcgcaacaacgtggtgcgcggcggccgcgcgttgggcagctcgggaccgccctcggacggcaccgcgggcttcgtgggtccccccgccccgcgcgtcctgcagaacttccaccccgacgaggcggagagcgatgaggacaacgacgtcgtcatcgagggcacactggagcctgcacgtcccccccagaccccgggcgcgcccgcaggcagcctctcccgggtcaatggcgcgggcctggcgcagcggctgcagcgggacctggccctggacggcggcctccagcggctgctcagctccctgcgggccgacccccgtcacagcctggcgctgccgccaggcggcgtggaggagcacgggcccgcggtcacgctctagactcccgagaggcccccaaatcctagctccagttccccggtaaggacagggacaggacctgcagactgcatccgctcattttttgttgtttttgtgaccacaaaaacaacgctgctctttgtttcaacttccggatataaaaacacaagtattgcctatttttatagaatttcgccacagaacttaaaatgaacgcctgtagagacactctataccaggcctgagtgcaggtcttggcgcctttgcaaagtgatagaaaagatctgaccaagtgctaaaaaatgctttttaaaatttttacaaatactttgtttttaaagtgaagcttttaaattacttttttaaaatagtccaattcatgtttttaagtaaga

SEQ ID NO: 69 - DNA, 1120 bp, Homo sapiens
  CDS (387)..(899)
ctggtgaccttgttgcagatgtgggttgtccccttatatttcacgataaaattatactggtggcggtttctgtctatgtgggggatgttctccgttattaccagttacatcctcttcagagctacccgaaaacccctctcaggaaggacaccacgttcacccctgcccactcccccacgcagctcacccctgcccgctcccccacgcagctcacccctgcccgctcccccacgcagcctacccctgcccgctcccccacgcagctcacccctgcccgctcccccacacagctcacccctgcccgctcccccacattggtctacaaatggtttcttttgatctacaaactcagctatgcatttggtgttgtgggttacttggcgatcatgtttacaatgtgtggattcaatctgtttttcaaaatcaaagctagagattccatggattttggcattgtgtctttgttctacggcctctactatggagtaatggggagagactttgccgagatctgctcagactacatggcttccactatagggttctacagtgtcagccggttgcctacaaggagcttatcggacaatatctgtgcagtctgtgggcagaagatcattgtggagcttgatgaagaagggctcattgaaaacacctaccagctttcctgtaatcatgtctttcatgaattctgcatccgaggttggtgtatcgttgggaaaaagcagacttgcccttactgcaaagagaaagttgatttgaagaggatgatcagtaatccctgggagcgcacacattttctgtatggacaaatcctggattggcttcgttatttggtggcctggcaacctgtggtgataggaatagttcaaggcattaactattcactagggctggaataggacagcagaccccagaagcaacatactgcatggttgaaatccttggtccaacatttaatattaatttttttaattttagagatgatcccaagtgtttagaaaactaagtaaactttgttgtcaagcaatttgtccatgtggaaagaatttaaagagaagctgaacaatggaataaacaaataaagcatgttttttcatctttcccattaaaaaaaaaaaaa

SEQ ID NO: 70 - DNA, 1254 bp, Homo sapiens
  CDS (343)..(1254)
cagagcaagcccctgtctcaaataaaataaaataaaataaaatataaaataggaatgctatgtggttgtagcagatgaaagtgctgtttgtgtattaggttaaaatgggtaaatattagcaatttcatatacttcaacctaaagggcacctacccctaaggttgttacaaggattcagtgaaataagggaaccagttcacctaggaattaagaacacagtctctgggctgctgtccacctggcaagggagtcccatctgtccagattgtcccagatcttgctgcccgcccagtggccgaagtccttcaggtctggaggtcgtggtgtcacagtctccatgacatgttgatgctggctgagcagcagcagaagcagaagtgggctgtgaatactcaaaacactgcctggagtaatgctgattctaaatttggccagaggatactagagaagatggaatggtctaaaggaaggggtttaggggttcaggagcaaggaggcccagatgatattaaagttcaagttaaaaataacgacctgggacttcaagctacaatcaataatgaagccaactggattgcccatcaagatgattttaactggcttctggcggaactgaacacttgtcagaggcaggaaacagcagactccttagacaacaagaaaaagaaatattttagtcttgaagaaattccaaaatcttcaaaaactgtgttcatcataggaaatttacaaaagaaaaggatctatcatctcggagcaaaacagatcgtgactgcatttttgggaaaaaacagagagcgttttgccaagcgaatggcagcactgaagaacaagccccaggttgcagctccagggcctgacatttccaagacccaagtggaatgcaaaagggggaagaaaagaaacaaagaggcaacaggtaaaaatggggagagttaccccccaacacagcctaaggccaagcggcctaaagagggaaagcctaagagagacaaggtccagaagtcggcatccaaggagaaaagagcacggacagacggacagtgcagaggcctctgctgggaagagagttctgaggcctctgctcagggtgcagggaattgtgtgcagccacctgatggccaggatttcaccctgaagcccaaaaagacaagaggaaaaaaaaaagctgcaaagccagtagaggtagcaatggacactacgctgaaagaaacaccaatgaaaaataagaaaaagaagaaaggttccaaatga

SEQ ID NO: 71 - DNA, 594 bp, Homo sapiens
  CDS (17)..(493)
tcaatccgccagaatcatgggctgctgtggctgttctggaggctgtggctctggctgtgggggctgtggctccggcagtgggggctgtggctctggctgtgggggctgtggctccagctgctgtgtgcccatttgctgctgcaagcctgtgtgctgctgtgtgccagcctgttcctgctccagctgtggctcctgtgggggctccaaagggggctgtggctcttgtgggagctccaagggtgggtgtggttcttgtggctgctcccagtccaactgctgtaagccctgctgctcctcctcaggctgtgggtcattctgctgccagtccagctgctccaaaccctgctgctgccaatccagctgctgccagtccagctgctgcaagccctgctgctgccaatccagctgctgccagtctagctgcttcaagccctgctgctgccagtccagctgctgtgtccccgtgtgcttcaggtttctcctcatttggtgaaagcatttcttatggtttctctgaatcagttcatcccacacatcatcctgaggcacctgcacctgctctagctcatcatccatgcatgcacctctttccat

SEQ ID NO: 72 - DNA, 4819 bp, Homo sapiens
  CDS (300)..(2324)
catgccacctgcttctggcgccccgctggaccctgcttcgaagggaccgtttggtcgccagagggcggttcctggagttacagccgcgtttgcgggacgtgtctgcgcggcagtcctggcctgttgagcttgtccagacgaagcctcgcagggatgggttggagcccgggccgggcttcgctcaggcagcgtttgaggcagacccagcagggtcctcctggggccttcctgcctttgaactgcggtggcgggcgggcgcacggtctcctgtacgccctagactaggggccgccatctccatggccacggccgtgagccggccctgcgccggcaggtcgcgggacatactgtggcgcgttttgggctggaggatagttgcaagtattgtttggtcagtgctatttctacccatctgcaccacagtatttataattttcagcaggattgatttgtttcatcctatacagtggctgtctgattctttcagtgacctgtatagttcctatgtaatcttttacttcctgctgctgtcagtggtaataataataataagtattttcaatgtggagttctatgcagttgtgccttctattccttgctccagactagctctgatagggaagatcattcatcctcagcaactcatgcactcatttattcatgctgcaatgggaatggtgatggcctggtgtgctgcagtgataacccagggccagtacagctttcttgtggttccctgcactggtactaacagctttggtagccctgctgcgcaaacctgcttaaatgaatatcatctttttttcctactgactggagcatttatgggctatagctatagcctcctgtattttgttaacaacatgaactatcttccatttcccatcatacagcaatacaagttcttgcgttttaggagatctctgctcttattagttaaacacagttgtgtggaatcactgttcctggttagaaatttctgcattttatattattttcttggctatattcccaaagcttggattagcactgctatgaaccttcacatagatgagcaggttcataggccacttgacacagtgagtggcctcttaaatctctcgttactctaccatgtctggctgtgtggtgtctttctcctgacgacttggtatgtctcatggatactcttcaaaatctatgccacagaggctcatgtgtttcctgttcaaccaccatttgcagaagggtcagatgagtgccttccaaaagtgttaaatagcaatcctccccccatcataaagtatttagccttgcaggacctgatgttgctttctcaatattctccttcacgaagacaagaagttttcagcctcagccaaccaggtggacatccccacaattggacagccatttcaagggagtgtttgaatcttttaaatggtatgactcagaaactgattctctatcaagaagctgctgctacgaatgggagagtgtcttcatcttacccagtggaacctaagaaattaaattctccagaagaaactgcttttcagacaccaaaatctagccagatgcctcggccttcagtgccaccattagttaaaacatcactgttttcttcaaaattatctacacctgatgttgtgagcccatttgggaccccatttggctctagtgtaatgaatcggatggctggaatttttgatgtaaacacctgctatgggtcaccgcaaagtcctcagctaataagaagggggccaagattgtggacatcagcttctgatcagcaaatgactgaattttctaatccttctccatctacctctattagtgctgagggtaagacaatgagacaacccagtgtgatttattcatggattcagaataaacgtgaacagattaagaatttcttgtcaaaacgggtgctgataatgtattttttcagtaagcacccagaggcctccattcaggctgttttttcagatgcccaaatgcatatttgggcattagaaggtctgtcgcacttagtagcagcatcatttacagaggatagatttggagttgtccagacgacactaccagctatccttaatactttgttgacactgcaagaggcagtcgacaagtactttaagcttcctcatgcttccagtaaaccaccccggatttcaggaagccttgtggacacttcatataaaacattaagatttgcattcagagcatcactgaaaactgccatctatcgaataactactacatttggtgaacatctgaatgctgtgcaagcatctgcagaacatcagaaaagacttcaacagttcttggagttcaaagaatagttaagtaatataaactgtgttcattacactgctgatacaactacagatgggacagtaaatgttcagcattcttggatcagaagaaaacggactaattagatgcttcctttgtcgtggtggttgctttgaaaactatactttaatgggagaaatcatggaaagaaattctcaacagaataactgaaaactgccttttctgtaccgattgctttttgtgtgtgtggtataataaaatctttattcaattttacagaagcattgatggcagtcgaaatgtctctagctcatataacttaatagtaataactaaaaaacttttagaatttacttttgaaaggagggaagccagttctgaaatgagtataggttgatttcatagtcttcttaattaagagtttagctctttgtaaactcaaaatacataaactttttaagtgtagtttcatttactgaaggataaaaatggtaacagtgcagcaatattcacaaaaaatattgtctaacggacatattttgttaatctgttaggttgggtttttgtttccagggacaaattaaatttgtatgattacccaaaaaagggtctcagtttacagatgctaactctatataaaggaatgtggaaaaactcagttcttaagttacaagattaaaaattcacatttggtctttaagaaacaattgactgacatctatgaatttattttgtatcatgctagtaaacacgaagtattaatgtatgggtattttcccagctagttttgctttctttttctggagcaaaacattaagtgattgcagagtttttcaagcaagagaaaaaggtttgcaaaaaaacccaggaaatgttcccttttttccccaccattcatcttcattagatcaaattctgtgaaacttgtctggtctctcaaagggagcagcctctgtagtgttaaatggctaattaaaataggaagatctttatagccagaaacaacttagtcatcaaatagcaagtgaaaccaaaacgtcagagggattactgtacttggaagtatgttgtgtgtcccaaatgtgaacgaagtattgttagaatttattagatcagcttctttggagatcaaagattggaaatcctagtcatagatattcactggactggctttggactgaaatgctcctttgtaattcttttcctattgtcttttccttctagtgtcccaaaatattttctttaaagtcagcacagtactgtatatgaatctttaatgtggtatcatatatgtctacttttgtctgattcatcgatgtattatatctttataattgaatattttagctccgggtcctgttgccccttcaagcagtacatgccaaattataaataggtgctactggccttgagcatatcactgtgggacagttccccaattgtcaagtgtttagatatgtagactattgccatttgtttttttgttttggttttgctttgtgtctgaagctgaattgatttcttttttttgaatgtgaaagttgaatttcaaacgtagtcatttcttacagatggccaagacagaaaattgtggctaggttgactgagaactgttgtcttccatgtattaacacaattaagctttttatattccactctctgtgctgaccctggctgaggcattttgggagacaaggactctgaatcttctgcttccattaaagaagaactgtgatattcaacattggatttctgagaataaagataggatgattcctttgaactttgacttacttgtataaaatgtccagctaggttaggtttttgccatttcctatatactttgggtaaagctacatttgatgagcaatgtgaatgtttctgagaatgttcattcctgttttctcttaagagaatgtgctgtgtactaaatacaggccacatagtgtctgcctgttgaagatctggaaactgcctccccagatctgtattgtatttggtaggtaagggggtcagtttctttttctcattgtgtgttgataatctacacaccatctgttggaaccagggtgttattatggggaactcctcctgtgtactaggaggaggaccttagggagaccaagaggagagaagcatttcctttgatgaagtcacatcctgtctatgagcccactaatgctgtaacattggcctgaaagagagtgttctttaaaagcctttctcggctgttagtataaaaacatgatggtatcagctcttagcatgtttgcttgacccttatggaaggtataaatccacagaacttccttcccagagaactgggaaattgtcctagaaataaaccttgtacagttgagtggacatggataagcaacaatttgttactttgcaggatttgttccttggtaattgtttggtgtgtcatcctgtaaatattcatgatagtctgtttatatccttttgtatatcgttgatactggattgggtagaaaaataaattggcaatttaaaaaaaaaa

SEQ ID NO: 73 - DNA, 1593 bp, Homo sapiens
  CDS (228)..(1253)
gcacgagcagcgagctgccccggggtctctccggtttcctaatcagggcaacgccgcgggagagaacctttaccttggctgcactaagttctcggtgccactccctggcagggcgggaccttgtttaggccctgtgatcgcgcggttcgtagtagcgcaaggcgcagagtggaccttgacccgcctagggcgggaagagtttggcccgccgggtcccaaagggcagaatggacgggctcctaaatcccagggaatcctctaaattcattgcagaaaacagtcgggatgtgtttattgacagcggaggcgtacggagggtggcagagctgctgctggccaaggcggcggggccagagctgcgcgtggaggggtggaaagcccttcatgagctgaaccccagggcggccgacgaggccgcggtcaactgggtgttcgtgacagacacgctcaacttctccttttggtcggagcaggacgagcacaagtgtgtggtgaggtacagagggaaaacatacagtgggtactggtccctgtgcgccgccgtcaacagagccctcgacgaagggataccaataactagtgcctcgtactacgcgacagtgaccctggatcaggttcggaatatacttcgttctgacacagacgtttccatgcctttagtagaagagaggcatcggattctcaatgaaaccgggaaaattctgctggagaagtttggaggctcttttctcaactgcgtccgagaaagtgagaatagtgcgcagaagttaatgcacctggtggttgaaagttttccttcttacagagatgtgactctgtttgaggggaaaagagtttctttttacaaacgagcccaaatccttgtagcagatacgtggagtgtattggaaggaaaaggagatggctgcttcaaggacatctccagtatcaccatgtttgctgattatagattacctcaggttcttgctcatcttggagccctgaaatactctgatgacctactgaagaagcttctcaaaggagaaatgctctcatatggagacaggcaagaggtggaaatcagagggtgctcgctttggtgtgttgagctgatccgggattgtcttctggagcttattgaacaaaagggtgaaaaacctaatggagagatcaattccattcttctggattattacttatgggactatgcccatgaccatagggaagatatgaaaggaattccgtttcatcgcatacgttgcatatattattgacctcaagtgtaaactgatccaaagaaaaccccctgcgttttatatcatatcatctgtacagttttgctttgatatttagagaacatgatcgaggttataggaaattgattgcccattctcacttgaaaaatacttcctaggccgggcacagtggtttatgcctgtaatcccagcactgtgggaggctgaggcgggtggatcatctgagatcaggagtttgagaccacctggccaacatggtgaaaccccatctctactaaaaatacaaaattagctgggcgtggtggcacgtgcctgtaatcccagttacttgggaggctgaggcaagagaatcgcttga

SEQ ID NO: 74 - DNA, 2671 bp, Homo sapiens
  CDS (228)..(2012)
gcgcacggcttgcccatgtgtgctgcagccgtcagccggcccagctgagcagcagcaacggaccttgttaacggcgcggcagcctccaccgcctgctgttgccctcctctctcggtggtctgtccgcccagcgcacgtcaccatgggcaagagccggacgaagcgcttcaagcgacctcagttctcccctacgggcgactgtcaggccgaggcggctgcggcggcgaatgggaccggaggcgaggaggacgacgggccggcggcggagctgctggaaaagaaatcccagtgcttgtggaggttttgaagtttgtgatgacatggtgactaaggatatcatgacccctctggttgcgctgctaaaagagtgtagtgctggactggattcaaatgagatgtctctgcaggagaaaaaagatcagaacagaaattctattgagaacatagccaatgagactgtgaacgtgctgtggaatatatgtgaatgcagtagtagagcagtgtctatattcaacaaagaagggtgtttggagattgtgttaaagtatttaagtaggttccctaccaatgttgacctggctatttcagtagcatattgtttgcagacagtgactgaggataacccagagctgctgaagtctttcagtgctacagcattgaacatgctggaatcagcactgctttctcctgtcagttccatggaatctcttctattgaagacattggtagcaggcacaatttggaatctaaaggacattattccatgcaagagtcaagcagaaatcataaatgccttactaaagatcttatctgaagttttgggaatggatgctggtgaaatggttattcaaatgaaagaggctgaaacgcaaaggttaaaaactgctgcagaggctgaggaaatattagagaacactaatggggatgatttgattgaagatgatgaaatggaaggaatttctcataaaagaagagtcagaaggaaaactttcgtttcagatttacttccgcccactgacaaggaactgagagagactatagcattgctgacagcccaacagactgctctggaaattattgtcaacatgtgctgcaatgaagatccctctgatgacgaatgggaagagctttctagcagtgatgaaagtgacgcatttatggagaattccttcagtgagtgcgggggacagctgttttctcccctctgcctctcccatgaagttcacacggctctcaccaactacctcatcccaaagaagatttttgagaaaactgcctttccaaacagcattgcagttgacctatgttctaggaaccctacttggaaacctttgattagaaaaatgaacactattcagtgcagagccctcttctgtctccagagtcttgtgtccctcctggatgtggagcacctgggaggagccgcagcccttcagacgcttgcacagcatctgtcacagctgcttttttctcaaccagattttgctaaacatgttgactttctagaagccataagtagtgctttgagggcccttttgcaaacaatggcctccaagaacatttcccagtgcatgactcctgatcagctgatgacattatgcaaagcaggcattcatagtagtaatgtcggggttagagtgaatgtcgttagcattttaggaatcactggcagcgtccttgccaaagaagatggtacacttgaaactcttaagaacattgggtgctttctgcttgaagttaccaccaaagatccttcccttgtggtagcaggagaagctttggatgccctctttgatgtttttgcagatggtaaagaagccgaaagagcctcgattcaaattaaattattatctgctctgaaagaattccagccggtctttaaaatgaagatacgtaaagaagggagaggtaactatagcacagatcagctgtgtgttcttgacaatgtgaaaatgaatttgcgaagatttattgcttatcaagaaactgttgagaaaagactgacttcttaaacaatccaaaaaagaaaccagttcttcccccaaagtattcaatgcttagaatactaaaaggttttctttgaatgtatatgtttctgaaagtcattttttaatgattacaggcatgagccaccgtgcctggccagaaactcttttttaagcgatgagatctgtgtggcatttctagcgctctctaaattatgtctctggcatattttaatcactggaaactcaaagagtggaagagtggaagtgcgaaggaatctcaggtagctcttaactaattcgccagcagtgaagaaacttcaaccaatcatgttttccttgaattttgcaaagaaagaaaatccaaagcattgcttggatgttcttttaaggcattttatatcagttgaaccttaaactgaaatatgaagacaagctttataaactagttttttgatatgaagtatatcaattatgtttgccttttgtgaagaagtaaatgagttgaatttgtatttcacttactagattatactaatgagctaatggggtcattgccatcctccctactcatgactttgatgagttattgctgtaacatcacttcttgatttaatttgatatggaatcagaattgggagaaggtatttttaaataaacaactttttaatggaaaaaaaaaaaaa

SEQ ID NO: 75 - DNA, 857 bp, Homo sapiens
  CDS (58)..(759)
atttggccctcgaggccaagaattcggcacgagtggggcgcgggcgatttgtaggtaatggcaggcgttcggtcactgaggtgtagcagaggatgcgctggcggctgtgagtgcggcgacaagggcaaatgcagcgactcctcgctgttgggcaagagactctccgaagactcgagccgccaccagctgttgcagaagtgggcgagcatgtggagctccatgagcgaagacgcgtcggtggccgacatggagagggcgcagctggaggaggaggcggcggctgcggaggagaggccgctggtgttcctgtgctccggctgccggcggccgctgggcgactcgctgagctgggtggccagccaggaggacaccaactgcatcctgcttcgctgtgtttcctgtaatgtttctgtggataaggaacagaagctatccaaacgtgaaaaggaaaatggttgcgtccttgagactttgtgctgcgcggggtgctcactcaatcttggctacgtgtacagatgcacgcccaagaatcttgattacaagagagacttgttttgcctcagtgttgaagccattgaaagttatgttttagggtcctctgaaaagcaaattgtgtcagaagataaagagctttttaatcttgaaagcagagttgaaatagaaaagtctctaacacagatggaagatgtcttgaaagcattacaaatgaagctgtgggaggccgaatccaaattgtcctttgccacttgtaaaagctgaactctagtctgtgtcctccattctgcccccgcccttcctccccttatttgttaaatgaagcaacatagtgagacgtcgtctctacaaaaaaaaaaaaa

SEQ ID NO: 76 - DNA, 2200 bp, Homo sapiens
  CDS (196)..(1713)
atcttttaattttacaagttagaagttggaagcctatatttttatatgaagtctgatttttaaatgttggcatctagtttttgcaaaggttaaatattgtgcaggccaaataaaaacatctgtaggctggatttggcacttaaattcccagtttgtgaccactactctaggcttatttcagctgatgttctaatcatgtcagataaagatgatattgagactccactgctaactgaagcagcccccatccttgaagatggaaactgtgagccagccaagaattctgagtctgttgaccaaggtgccaaaccagagagtaaatcagaacctgtagtttccactcggaaaagaccagagaccaaaccttccagtgaccttgagacttcaaaagttctccctattcaggataatgtttccaaagatgtaccccagaccagatggggttattgggggagctggggcaagtccatactctcctcagcctcggctacagtagctacagtaggacaaggcatttcaaatgtcatcgagaaggcagagacttcccttggaatccctagtcccagtgaaatttcaactgaagtcaagtatgtagcaggagagacaaatgccaaagagaatgaaaactcctccccagtggctggggcatttggtgtattctctaccatctctactgctgttcagagcacaggaaagagtgttataagtgggggtttggatgccttagaattcattggaaaaaagacaatggatgtgatagcagaaggggatcctggatttaaaagaaccaagggtctgatgaaccgaaatgctacactatctcaggttttacgagaggcgaaggagaaagaagagatacggacctccaatgaggttaccgtggaaacagacaagaaaactcattatgggctactctttgatgaatttcaaggcctttcacatctagaagctctggagatgctttcccaagaaagtgaaataaaggtgaaatctatccttaattctctgagtggagaagaattagagactctaaaagttgaattagagcaactcaaagaaacattttctctagcagaattttgtgaagaagaggaagaagagaaaaaaggggatgaagattttaccaaggacataacagagctgttttcccagctgcacgtttcctccaaaccagagaaacttgccagggcaagaaataccgcccacgaatggatcaggaagtctctgaccaagccattagcagagaatgaagaaggagaaaaacagtcggaagcagaaaatactgagcaagtcaacaaaaattcaatagaggatatccatgcgtttgcaatccggagcctggctgaactgactgcctgctcaattgaactattccacaaaacagctgcattggttctgcatggcaggaagcaggaagtgacagccatagaaaggagccaaactctttcccagatgacaattgtgttgtgtaaagagttgtcctctctgtctaaagagttcactacctgcctaacaactgctggggtcaaagaaatggcagatgtccttaacccattaatcactgcagtatttctagaggcatcaaacagtgcctcctacatccaggacgcctttcagctactcttacctgtgctagagatctctctcattgagaacaagattgaatcacacagacatgagctgcagggccagaaacctttgttagaacattgaagaatggagacgttttgacctgggacttgtgacggccaaggaatgccaccttattctggctactcctgcagaaatgaaggagtggggttattttagtatataaaaattcaggcaggagagatggtttaaagaggaagattgttgccttcagtgtttgattgaagtattcaggttctcacagtattctttccagttgttgtaattcataaattatttgaaaagaaacttttgtagaaagtccaagaataataactctagataaagattagtgggacactcaggcaaaaatgttggtctttctttgacatgttgcaaaatgttatcaattttgtcatggatataatttgcagcccatggatataactggttgataagccagagaaaaataatttagtgttctaaaattcatggcatgtgtggtttattaatgccatgtactttctcctttctggaataaaatctatggctttaagaaaaaaaaaaaaaa

SEQ ID NO: 77 - DNA, 2818 bp, Homo sapiens
  CDS (147)..(1112)
cacgaaaccccctaaagccttaaaataaactttctttgatttcttctcttttggtttgtgtttctgtttttccagaaaatgttcctgagaaagatcttcatggaagactttttatcaaccgtatttttcatatcagtgctgacagaatgtttgaattgctctttaccagttcacgctttatgcagaaatttgccagttctagaaatataatagatgtagtatctaccccttggactgcagaacttggaggtgatcagctgagaacgatgacctacactatagtccttaatagtccacttactggaaaatgcactgctgccactgaaaagcagacactgtataaagaaagtcgggaagcacgattttatttggtagattcagaagtactgacacatgatgtcccctaccatgattacttctataccgtgaacagatactgtatcatccgatcttcaaaacagaaatgcaggctaagagtttccacagatttgaaatacagaaaacagccatggggccttgtcaaatctttaattgaaaagaattcctggagttctttggaggactatttcaaacagcttgaatcagatttgttaattgaagaatctgtattaaatcaggccattgaagaccctggaaaacttactggcctacgaaggagaaggcgaaccttcaaccgaacagcagaaacagttcctaaactttcctctcagcattcctctggagatgtgggcttaggtgccaaaggggatattacaggaaagaaaaaggaaatggaaaactataacgtcactcttattgtggtaatgagtatttttgtgttgttattagttttgttgaatgtgacactgtttctgaagctgtcaaagatagaacatgctgctcagtccttttaccgtctccgcctccaagaagagaaatctttaaatttagcctctgatatggtgtcaagagcagaaactattcagaagaataaagatcaggcccatcgtttaaagggagtgctccgagactccatagtgatgcttgaacagctgaagagctcactcattatgcttcagaaaacgtttgatctactaaataagaataagactggcatggctgttgaaagctagtgatctgaaggactaaaaccgcagagatacttggaacttaaagaaaatacctggaagaaaaccagacgaatgaaggattttggcatagaacatttctatgttttttcattattgagatttctaatatgaacatttctttcagtaacatttatttgataattagtttctgctggccttaataatccatcctttcacttcttatagatatttttaagctgtgaatttcttcagtgaaccatgaaatatattatagaactgaatttctctgatacaaaaagaaaatgacacaccctgaattgagtggtatggtctcatttctacagtgaagtctgatgctttgttagcacagaatccgtacatgtccaataggtcgcttttgtaactgagataagaccaagaggataaacaggacaatataagaagaaacctctatgtcattactgattttaaaggttctgttttcaggcatataacatttccaggtttgtgtactgtaaagattataatgtcttcatttatttagcatgcaaatttaatagtcaaactttttgaatctgcatgttgatgatgattatcagaaagggtcttctgccatgctgtatctttatgaaagaaatagttgttttttcttaaggtaactatcagaggtgggattatcttgcctcctcacttagaataccaacagtcaaaaggaagaaccatcctctgagttttaaaaaccagaaggttatgttaaaatctgggcatttagtgacagatcaaatgcatacttgaactaagattggcttcagcttagcagtctttcatggtggaagtgacacatctggttgaaaataatttgtgtattttcagtaaccatgtatggcttccttctttatgtatgtgtgtgacttgttttgattggtaagttataagccagacatagattttagctctttaataaaaacttcaggggcacgtatgtcccagtacaagtgtactgactatcaagttttaactcagatgcaagctttggctctttcataaaaagtttttatgcatatgtgtctccatacaagtggctcattaaaataagaactttgtaaactgacttaaaatcagatattttttcaagagttagggaaagttgaagtgttttactgttttgtctcttgagccctttctctggggaaaaaatacatatccatctatctatctatatataaactgtgtatacattcttactgtttgaacaactattgcctttaattaaatgtttcatttttctccagagtccccaaagccacatggcattattatagtcatttttgagatgcctgtagagaatgaaagtattgactccgttagagggaaaatgggtttctctgggtgaattccaacgaagcatacctaggggtaacagtgaacctacctgggtttgttttgttttggtaaggatttatgtagtgtctggctgtaagcaagaatgagtggattataaacttgaagatttctctgttaaagtcacaaaaatgatcgacaaacaatatttttgtgatgtttatttaaacgttgtattttataacatacttcaaggaagagtatcgaagtaagttgctttataaattaagactaaattcgtatggatgcagaattcaattaataaaatttgagcctgttacgtaaattgaatattaataaaattgaaaatttcaaaaaaaaaaaaa

SEQ ID NO: 78 - DNA, 1946 bp, Homo sapiens
  CDS (465)..(1307)
tacatggcgagcaaaaaaacaacgctgagagaatcttttctctaatgccagagaaaaatgaacattcctattgcacaatgatccgaggaatggtgaagctgatgtatacacatttaatgcattgattgaagcaacagtatgtgcgataaatgagaaatttgaggaaaaatggagtaaaatactggagctgctaagacacatggttgcacagaaggtgaaaccaaatcttcagacttttaataccattctgaaatgtctccgaagatttcatgtgtttgcaagatcgccagccttacaggttttacgtgaaatgaaagccattggaatagaaccctcgcttgcaacatatcaccatattattcgcctgtttgatcaacctggagaccctttaaagagatcatccttcatcatttatgatataatgaatgaattaatgggaaagagattttctccaaaggacccggatgatggcatataagttttttcagtcagccatgagcatatgctcatctctcagagatctagaacttgcctaccaagtacatggccttttaaaaaccggagacaactggaaattcattggacctgatcaacatcgtaatttctattattccaagttcttcgatttgatttgtctaatggaacaaattgatgttaccttgaagtggtatgaggacctgataccttcagcctactttccccactcccaaacaatgatacatcttctccaagcattggatgtggccaatcggctagaagtgattcctaaaatttggaaagatagtaaagaatatggtcatactttccgcagtgacctgagagaagagatcctgatgctcatggcaagggacaagcacccaccagagcttcaggtggcatttgctgactgtgctgctgatatcaaatctgcgtatgaaagccaacccatcagacagactgctcaggattggccagccacctctctcaactgtatagctatcctctttttaagggctgggagaactcaggaagcctggaaaatgttggggcttttcaggaagcataataagattcctagaagtgagttgctgaatgagcttatggacagtgcaaaagtgtctaacagcccttcccaggccattgaagtagtagagctggcaagtgccttcagcttacctatttgtgagggcctcacccagagagtaatgagtgattttgcaatcaaccaggaacaaaaggaagccctaagtaatctaactgcattgaccagtgacagtgatactgacagcagcagtgacagcgacagtgacaccagtgaaggcaaatgaaagtggagattcaggagcagcaatggtctcaccatagctgctggaatcacacctgagaactgagatataccaatatttaacattgttacaaagaagaaaagatacagatttggtgaatttgttactgtgaggtacagtcagtacacagctgacttatgtagatttaagctgctaatatgctacttaaccatctattaatgcaccattaaaggcttagcatttaagtagcaacattgcggttttcagacacatggtgaggtccatggctcttgtcatcaggataagcctgcacacctagagtgtcggtgagctgacctcacgatgctgtcctcgtgcgattgccctctcctgctgctggacttctgcctttgttggcctgatgtgctgctgtgatgctggtccttcatcttaggtgttcatgcagttctaacacagttggggttgggtcaatagtttcccaatttcaggatatttcgatgtcagaaataacgcatcttaggaatgactaaacaagataatggcagtttaggctgcacaactggtaaaatgactgtagataaatgttgtaattagtgtacacgtttgtatttttgttaatatagccgctgccatagttttctaacttgaaaaaaaaaaaaa

SEQ ID NO: 79 - DNA, 1490 bp, Homo sapiens
  CDS (269)..(727)
cgtcgcggaattcaatacaggctcaaagcaggcgacgggacaggaatgagaggatggatgctggcaggggcttggagagtctgagaagccaactggggccaaacaagttttagaacctctactggctgatgccaacatcatcagagatgaactgttcttaccagaaacttctctgctcctgacaccccacctctccccagaagagaagaaggagagtggccacgttgattcagccaagcacctccaggaggtcccctctggatgtcccatgaggctgcccctcagccacagcccagagcacgtggagatggctttgctcagcaacatcctagcggcctattcctttgtctcagaaaatcctgagcgagcagctctgtactttgtttctggcgtgtgcatcgggctggtgctgaccctggctgctttggtgataaggatctcttgccacacagactgcaggcggcgtcccgggaagaagttcctgcaggacagagagagcagcagcgacagcagcgacagcgaggatggcagtgaggacaccgtgtccgatctctccgtgcggagacaccgccgcttcgagaggactttgaacaagaatgtgttcacctctgcggaggagctggagcgcgcccagcggctggaggagcgcgagcgcatcatcagggagatctggatgaatggccagcctgaggtgcccgggaccaggagcctgaatcgctactattagggagcagcaggaccccggaaaccactggaggccgcctggaaaggagagcgtctgcagggacagtgggcacaaggaactgaacccagctctgctaatattgtgatttcagagaaaaagcaggacatgccccttttctagccaggaggattgctcctttttggccaaatgtatggagaagtagaaaaatcaaagcagttcatcaccctttccaggtctcggaatggtgctgaaaaatcctctccaacactgtggatggagatcggagaaacgcgactgtggtttctcttgatttctgaggatctcagaagtttcagcagacttccttgctctgtgttattcctttgcaaaaggaaagatcattatagcatgagggctgggaatagcagggtgaacttaacccaataaatgcaatttcctaaatgacttcatgctatggaggtgattctgattcaaatagcatgatccatgcttattatttaaggctgatttttaaaatcttgtgttgcaagggcaacctcgtccattttaactggcacctcagggattaaaatcctactttttagtgtagttcccacctcattcatgaaaatgaatagaactattgtattatgggagatgtgtcagtgaactagaaaatgtcaataacctcaaaggatgaagggtttttattttaaatagtttataaaatatatattgacatgcatatttgaaaatgctgcataaaaataaaagtggtgtgttttccccctcaaaaaaaaaaaaa

SEQ ID NO: 80 - DNA, 1448 bp, Homo sapiens
  CDS (568)..(984)
gctgcggaactgcgcgattgtggttcccgccgtatttcccgttccccatctagtaactcccatctcagcccacgtatctccctgagtggaaatctcgggccccagaccagtcgattgggaggtccgccctccccttcagcgacttggtctgtgtttgggcagttgccgcgacaacagtcacttccgggaaggggctctgcgaatctccttccgtcggtccgctcagaatcagctgtcctctcagactgtgtgggtggtttccccggccgcagctccgtacgggcttggattgctgggcctcggtgcaccccagcctcccccactcgggttctgagcttgagctggcggctctttaactctgcttcactgttgctcttggcaacatccacttccgggagcgagtgccgtttcccccgctcaccgcgggctagggagcgtgggattccggactgtgagcggctgttagtgcgtcgcagctgctggcgatccggcgaccctcggccggcaggacccgcgggccacgcagccggggccttctcaacgcctcagtacctcggcgggaccgccatggttctgctgcacgtgaagcggggcgacgagagccagttcctgctgcaggcgcctgggagtaccgagctggaggagctcacggtgcaggtggcccgggtctataatgggcggctcaaggtgcagcgcctctgctcagaaatggaagaattagccgaacatggcatatttctccctcctaatatgcaaggactgaccgatgatcagattgaagaattgaaattgaaggatgaatggggtgaaaaatgcgtacccagcggaggtgcagtgtttaaaaaggatgatattggacgaaggaatgggcaagaaacaagtggaagccggtgtctgtgttaccatggagatggtgaaagatgccttggaccagcttcgaggcgcggtgatgattgtttaccccatggggttgccaccgtatgatcccatccgcatggagtttgaaaataaggaagacttgtcgggaacacaggcagggctcaacgtcattaaagaggcagaggcgcagctgtggtgggcagccaaggagctgagaagaacgaagaagctttcagactacgtggggaagaatgaaaaaaccaaaattatcgccaagattcagcaaaggggacagggagctccagcccgagagcctattattagcagtgaggagcagaagcagctgatgctgtactatcacagaagacaagaggagctcaagagattggaagaaaatgatgatgatgcctatttaaactcaccatgggcggataacactgctttgaaaagacattttcatggagtgaaagacataaagtggagaccaagatgaagttcaccagctgatgacacttccaaagagattagctcacctttctcctaggcaattataatttaaaaaaaaaaaa

SEQ ID NO: 81 - DNA, 766 bp, Homo sapiens
  CDS (66)..(479)
  misc_feature (1)...(766): n = a,t,c or g
gagcggtaactgcgtatgagaaccgtacgaggngggccgacgggtcgccgctgcgccgggccgggatggcggccaccgcgctgctggaggccggcctggcgcgggtgctcttctacccgacgctgctctacaccctgttccgcgggaaggtgccgggtcgggcgcaccgggactggtaccaccgcatcgaccccaccgtgctgctgggcgcgctgccgttgcggagcttgacgcgccagctggtacaggacgagaacgtgcgcggggtgatcaccatgaacgaggagtacgagacgaggttcctgtgcaactcttcacaggtgcacaaatggagtccagaggaggctgtaagagccatcgccaagatccggtcatacatccacatcaggcctggccagctggatgttcttaaagagttccacaagcagattactgcacgggcaacaaaggatgggacttttgtcatttcaaagacatgatgtatggggattagaaagaactcaagacactcctgcttgatacagaacaaaaagagcttaacaggaccaacagggcttaagcccagacttgacgtaacagaaatgtgccaataggtaataggtaatttttctttctctgacttgttttgttttcttgaaataacactgttgtgtggctagaaaggaaaagatttagtgtggcttgtattcatgggatacaggacagggatggggctatcatcttttcttgaatagggctaaagaagtattttaccaaaaaaaaaaaa

SEQ ID NO: 82 - DNA, 2745 bp, Homo sapiens
  CDS (183)..(2423)
cctacattgagctataccttacatatctgtagaccctcatttctatcaccacgtgtggagatttctgcattttgggtacagaagctgatgagaatcaccctcagtttgtgcttttcctttgcaattctattggcacacccttggaccctaaatacattgattttgtaccattatttgttgcaatgacccaaacccatgtgatagcagcttcaaaagaagcattttatacctggcaatatcgtgtggcaaagaagctcacagcattggaaattaatcagatcacacggtctcgaaaagaagggagagaaagaatttatcatgttgatgataccccttctggatcaatggatggtgtgcttgattatagtaaaaccattcaaggcacaagggatccaatttgtgccataactgcatcagataagatattgattgtgggtcgtgaatctggcaccattcagagatacagtctacctaatgttggtttgattcaaaaatattcccttaattgtcgagcctaccagttatccttgaattgcaactctagccgtcttgctatcatagacatctcaggagttctgactttctttgacttggatgctcgagtaacggacagtacgggacagcaagtagttggagagttgttaaaattggaacgaagagatgtctgggatatgaagtgggccaaagataatcctgatttgtttgcaatgatggagaagacaagaatgtatgttttcagaaacttggatcctgaggaacccattcagacctctggatatatttgtaattttgaggatttagaaattaaatctgttcttttggatgagatattaaaggatccagaacatccaaacaaggattacctaattaactttgagattcggtctctgcgagatagccgagcactgattgagaaggttggaattaaagatgcatctcacttcatagaggacaatccacacccccgactttggcgcctactggctgaagcagctcttcaaaaactggatctatacactgcagagcaagcatttgtgcgctgcaaagattaccaaggcattaagtttgggaagcgcttgggcaaactactgagtgagtcaatgaaacaggctgaagttgttggctacttcggcaggtttgaagaggctgaaagaacgtatctcgagatggacagaagggatcttgctattggcctccggctgaaattgggggattggtttagagtactccagctcctgaaaactggatctggtgatgcagatgacagtctcctggaacaagccaacaatgccattggagactactttgctgatcgacaaaagtggttgaatgctgtacaatattatgtacaaggacggaaccaggaacgcttagctgaatgttactatatgttagaggattatgaggggttagagaaccttgccatttcacttccagaaaaccacaagttacttccagaaatagcacaaatgtttgtcagagttggaatgtgtgaacaagcagtgactgcatttttgaaatgtagtcaaccaaaggcagcagtagatacctgcgtacatctcaaccaatggaacaaagctgttgaattggctaaaaatcatagtatgaaagaaattggatctctgttagctaggtatgcatctcatttactggaaaagaataaaactcttgatgccatagaactctatcggaaagccaattacttttttgatgcagctaaactgatgtttaagattgcagatgaagaggcaaagaaaggaagtaaacctttacgtgtcaagaagctctatgtactgtcagccttacttatagagcaataccatgaacagatgaagaatgcccagcgaggaaaagttaaaggaaaaagttcagaggccacttctgccttggctggtttgctggaagaagaagttctgtctacaacagatcgtttcacagataatgcatggagaggggcagaggcttaccacttctttatacttgcacagaggcagctctatgagggatgtgtggacactgcactgaagacagctcttcacctgaaagactatgaagacatcatccctcctgtggagatctactctctgctagcactctgcgcatgcgccagcagagcctttgggacttgttcaaaagctttcattaaacttaaatctttagagaccctcagttcagaacagaaacagcagtatgaagaccttgctttagaaatcttcaccaaacatacttcaaaagataacagaaaacctgaattggacagccttatggaaggtggagaagggaaactgccaacatgcgttgccacaggaagcccaatcactgagtatcaattctggatgtgcagtgtatgcaaacacggtgtccttgctcaggaaataagccactacagcttctgccccttatgccatagtccagtgggataaaggaatgataaactgtatataactgtaaaatatatgtagcatatatacatggctatatgctgtatatgtaataaggtttatttctgtgagttttgtatgaaaatcagcctcattatttatagttgaatttttgcacaaaatatatgttaataaaataatttttatggcaatacaactgtgaaataataaggccgattttcatataaatgtatgaaaatcaaccatgttttatctcaccctctctcttttgtttatcttgtttttggttacatgataccatggaaatattccaaataaatttttttctcacaaaaaaaaaaaa

SEQ ID NO: 83 - DNA, 799 bp, Homo sapiens
  CDS (51)..(473)
gtaacgtcattcatccacattaactaatttcctcactccaagctcttttcatggagataatctccagtccctgtgcagaaactgtcattgcactttctgctgaaatggcagtttcttctcagcaaggtgagattatggaatccagaatcttttttcaggggtcacatgcccatttccccacttgcatgaatgtcgacactgcagccacagttttggccgtaaatgtgaatttggcaagtaaccactgttcccagggaaatgtcccaatcagaagaagattatctgggacactgatactgacagggagatgggacattctgagggacccggaggcagggtgccacctcctcaacttccctgagggctgcctagaatctgtttcctctcactctgaattattcttcctcttatggctgaccaaaaacatggaacctcacaaagtccactgtaacagctttatatttgtgaagtgaagaacatgaagacagtttcaagcaaagttattgagtggacactttgtgttttttttgagaagtctcgctctttcacccaggctggagtgcagtggcacgatctcggctcactgcaactccgcctcccgggttcacgccattctcttgcctcagcctcctgagtagctgggaccacaagcgcccaccacgtcagcttaatttttttgttttgtttcttgagacagagtcttgctctcttgcccaggttggagtgccgtgtcgcaatctcagctcactgcaacttctacctcctggattcaagcacttctccttgcatcagcctgtta

SEQ ID NO: 84 - DNA, 1708 bp, Homo sapiens
  CDS (132)..(620)
gcacgagctctggattaggcaggcagaggcagttatgggcttctgcagtggcgagaaaggaagcgcctgaagggtcgtgaggctggggcgggacccggcaccgctggggcggccaggccgtgaggacgccaatggcgagcagcgtggacgaggaggcgctgcaccagctgtacctgtgggtagacaacatccctctgtcccggcccaagcgaaacctctcccgggactttagcgatggagtccttgttgcagaggtcatcaagttttacttccccaagatggtggagatgcacaattatgtccccgccaactctctccagcagaagctcagcaactggggtcatctgaacaggaaggtactgaagaggctgaacttttcagtaccggatgacgtgatgcgcaagatcgcgcagtgcgccccaggcgtggtggagctggtgctcatcccgctgaggcagcgcctggaggagaggcagaggcgcaggaagcagggcgccggctccttacaggagctggctccccaggatggcagtggctacatggatgtgggtaaggtggccttttccatttctccctcccggttggagctttccttctgtccttcttcctgtcacttgtaagagtggaagtagggagggggaagcaggagaatgagactccagcacagtcattcctccacttgccttgtctcaggtgtatcccagaaggcccgaggtgaaggtgtcccggacccccagggagggggtcagctcagctgggaccggccgccggcgcctcggcctccagcgtataaccgggcgttgcagggcgaccccagcttcgtcctccagatcgctgaaaaggagcaggagctgttggcctctcaagagaccgtgcaggtcctgcagatgaaggtaaggcgcctggagcacctgctccagctcaagaatgtgcggatcgaagacctctcccggcggctccagcaggcggagcgtaagcagcggtgagcggcggcccgggccgcgcggggacgcccgggtacccgccagagccccgacgccgcgccggacccacccaccgatggatagaccattgggagggcggagcccgctgctctcacgagcctgctggggcccgagtgccctccttccttgggatgggtgagcgtgggaggagatgggacaggaactctaggagcgcaggcccgggactgagccgcctcctaccactccggagatccgggtcaggagaatggaccgctttccagagcccagaagccacgtgcagagacctagcctgtcccccaaagcagtgtccaacaccttgggcccggccttgcatctcccggcgctgggccttggggggcggtcccttggctctgtccacacccccagaatcaggtccccgcccagctccgaggacggcggcgtctccatccaggctagttccccatgccctcagccatgggggaatctgtcccgggccgctgaggggctcccctgcccctcctgggagcttacctgggacccacctcggcgacggagaccgcagcagctggagaggaaggggtgaggcgtgggatcgccaggagtagggaggacatcgacgatgtgcccgtagcagtcgcccctccctcctcgcgcacggggtactgaggcggaaggtttgaaggttacggctcagggctgccccattaaagtcagtgttgtgttctaaaaaaaaaaaaaaa

SEQ ID NO: 85 - DNA, 1051 bp, Homo sapiens
  CDS (64)..(915)
tttcgtgccgcgggcggcggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactcggacgaccagtggggagagtactcctgcgtcttcctccccgagcccatgggcacggccaacatccagctccacgggcctcccagagtgaaggccgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaaagctgtgggaacacgaagtgcaatgctaccgtcggcgagaagcctacctgaggaggggcaggaagacccgatccgtttggcggccgcccagtaccccaggtgacgaacaacgcgtgctccaaagaggccccgggtcccgacaactctccttaagagggggctcccacgggtgggatcaagggaagacgggacgcccgttatgcggggggatcaaccccacgtccacgccccgtataagc

SEQ ID NO: 86 - DNA, 1144 bp, Homo sapiens
  CDS (275)..(592)
cagcccattttacagatggcttttggcttgcccaaggggaccaccctctgaactgaggcgtccccaacccatgccgggagctggtggaggaagtggggaagggtttcccgcttctccactgggggtggaggtgggagaaagcattttcagggtgttttgacatttaacaaacagtatgcaaatcacatgcaaatcgcatgcaaatcaccacccatttcttaagcctcgacagcgctggcatgttctgaaataataatgttggacctgtcccttgatgatgacctgggtcgggaggtgcacggccttttccttcctccgtcttcccttcccttcccttcccttcccatctgttctcccttccttcgcccccttcctttcctctccctccctatcttccatttttctcttcttccttcacatcatttgtccaagacctccctggcctgagataaacataagttgcaaaagtggcttcctgcagcccattttccaggttgggaaactgaggcatgggcctaaggtcccacagccacaccgaggaaagcagcccccactgaatgtcaccatgcaccaaagtgcatggtcctcgtgacacaaagaggggagatgacagtggctggagttgtcagagctgctttgaggaagctccaggcctgataggcttgacagggccaaggggaactattgtggaatgtcttggccttgaatgacaggctgctgattttggatctggagaaagctcacactgactcttcctgctcccccagtctgtttttctcctgctactccatccatgtatccctgagtttgggccacagtccctccacttggtttgcatgtcccaccttctttgtttggcaagctcctattcatccttcaaagccctagcttcaatacctgctacttcatgcagccattgcttatccttcaaggagagcctacttccctcaaggaccctgctgcttccagtctcaccttctgactcactcgggatccactgaactgggaggtctgtgtctcctcccagcagagtcatcactacctttggggccgcaggatcacccagcttggaactagatacagaaatgctgttttgagagtgtactgaataaaagattacatgtttgaaaacaaaaaaaaaaaa

SEQ ID NO: 87 - DNA, 3382 bp, Homo sapiens
  CDS (232)..(2949)
ggcagctcccaacccccgtcctggacccacaaatcttctcgacccctggcccaccccggccgtcaccgagaacggtcccctagggtgcctagggacttccggagcccgaccggatccggaagcttctgagagcgagggggtggggccgaaaatcaaaaaaagcgcggcgaaagctaaaggccggcgcacgctgggcggtggtggtccctaagccgggccgcggccggtgcaatggactccactgcctgcttgaagtccttgctcctgactgtcagtcagtacaaagccgtgaagtcagaggcgaacgccactcagcttttgcggcacttggaggtaatttctggacagaaactcacacgactatttacatcaaatcagatattaacaagtgaatgcttgagttgccttgtagagctacttgaagaccccaacataagtgcttcactgatcttaagtattatcggtttgctgtctcaactagcagtagacattgaaaccagagattgtcttcagaatacatataatctgaatagtgtgctggcgggagtggtttgtcggagcagccacactgattcggtgtttttgcagtgcattcaacttctacagaagttaacatataatgtcaaaattttctattctggtgccaatatagatgaattaattacgttcctgatagatcacattcaatcttctgaagatgagttaaaaatgccttgtctaggattattggcaaatctttgtcggcacaatctttctgttcaaacgcacataaagacattgagtaatgtgaaatctttttatcgaactcttatcaccttgttggcccatagtagtttaactgtggttgtgtttgcactttcaatattatccagtttgacattaaatgaagaggtgggggaaaagctattccatgctcgaaacattcatcagacttttcaactaatatttaatattctcataaacggtgatggcactctaactagaaagtattcagttgacctactgatggatctccttaagaatcctaaaattgctgattatctcaccagatatgagcacttttcttcatgtcttcaccaagtattaggtcttcttaatggaaaggatcctgattcctcttcaaaggttttagaattacttcttgccttctgttcagtgactcagctgcgccatatgctcactcagatgatgtttgaacagtctccacctggcagcgccactctgggaagccatactaaatgtttagaacctactgtggctctactgcgctggttaagccaacctttggacggatcagaaaactgttctgttttagcattggagttgttcaaggaaatatttgaggatgtcatagatgctgctaactgttcctcggctgatcgttttgtgacccttctgctgcctacaatccttgatcaacttcagttcacagaacaaaatctagatgaggctttaacaagaaaaaaatgtgaaaggattgccaaggccattgaagttttgttaactctctgtggagatgatacactaaaaatgcatattgcaaaaatcttgacaactgtcaagtgtaccactcttatagaacaacaatttacatatggcaagattgacctgggatttggaacaaaggttgcagattctgaattatgcaaacttgctgctgatgtaattttgaaaactcttgatttgattaacaaacttaaaccattggttcctggtatggaagtaagcttctacaaaatacttcaggacccacgtttgattactcctttggcttttgctttaacgtcagataatagagaacaagtacagtctggactgagaatattattggaggctgctccactgccagattttcctgctttagtacttggagaaagtatagcagcaaacaatgcctatagacaacaggaaacagaacatatacccagaaaaatgccctggcaatcatcaaatcacagttttccaacatcaataaagtgtttaactcctcatttgaaagatggtgttcctggattgaatattgaagaattaatagagaaacttcagtctggaatggtggtaaaggatcagatttgtgatgtgagaatatctgacataatggatgtatatgaaatgaaactatccacattagcttccaaagaaagcaggctacaagatcttttggaaacaaaagctctagcccttgcacaggctgatagactgattgctcagcatcgctgtcaaagaactcaagctgaaacagaggcacggacacttgctagtatgttgagagaagttgagagaaaaaatgaagagcttagtgtgttgctgaaggcgcagcaagttgaatcagaaagagcgcagagtgatattgagcatctctttcaacataataggaagttagagtctgtggctgaagaacatgaaatactgacaaaatcctacatggaacttcttcagagaaatgaaagtactgaaaagaagaataaagatttacagatcacatgtgattctctgaataaacaaattgagacagtgaaaaagttgaatgagtcactcaaggaacaaaatgaaaaaagtattgcccaattaatagagaaagaagaacagagaaaagaagtacagaatcagctagtagacagagaacataagctagcaaatttgcatcaaaaaacaaaagtacaagaagaaaagattaaaaccttacaaaaggaaagggaagataaggaagaaaccattgatatccttagaaaagaattaagcagaacagaacagataagaaaagagttgagcattaaggcttcctccctagaggttcaaaaggcacaattagaaggtcgtttggaagagaaagagtccttggtgaaacttcagcaagaggaattgaacaaacactcccacatgatagcaatgatccacagtttaagtggtggaaaaataaatccagaaactgtgaatctcagtatatagacattatggcattttggaatttgtaatctcatgatatttttgatgtatttatctattggagggggggtgggtaggggagttaatttgtgacttcgtaacaataagaagttattatctaatttagtaaagaccctgatctgttgcatgttttttatttgatagtttgaatagaaatttaattttctaagttttactttttgtttctggcttttatggcttaaggttttctttggttcttacattagaaaatcatttttaacctccattatcatttttctaaggttctttcctttttcttagttgctttctattctgttttgcctgtcttatttattctcatttgtgattatttagatcttaagaccaaactttcttggtataacagtcctaaagattacaaaataaaaatatagagagagtaaaagtaaaaagt

SEQ ID NO: 88 - DNA, 4166 bp, Homo sapiens
  CDS (1)..(3465)
atggtgactcccagaattgtctgcctggacagtgtccagagcactggttccaccttagccgctgccagagtcacgtttgggccatgggatacaaggagaaccccactgtccctggctgaggggaggaccagagcctgcactcagcgcagatttgaggctggtgtggtccagtgggttgaaggtaacgagtctgaccttgaactagaaaagaagtgtaaggaagatgatcgggaaaaagcctcgaaaagaccacggtcacagaaaacagagaaagtccagaagatctcaggaaaggaggccagacagctttctggggcgaagaaacccatcataagtgtggttttaactgcacacgaagcaattccaggtgctaccaagattgtgccagtggaggctgggccccctgaaacaggagctacaaattctgagaccacttcagcagacctggtgcctcggagaggctaccaggaatacgccattcagcagacaccttatgagcaaccaatgaagtcaagcaggctaggtcccactcagctcaaaatcttcacttgtgaatactgcaacaaggtcttcaagttcaagcactcgctgcaggcccacctgaggatccacaccaatgaaaagccatacaagtgcccccagtgcagctatgccagtgccatcaaggccaacctcaatgtgcacctgcgcaagcacactggagagaagttcgcctgcgactactgctcgttcacctgcctgagcaagggccacctcaaggtgcacatcgagcgagtgcacaagaagatcaagcagcactgccgcttctgcaagaagaagtactctgacgtcaagaacctcatcaagcacatccgagacgcgcatgacccacaggacaagaaggtcaaagaggccttggacgagctctgcctgatgacgagggagggcaagcggcagctgctctatgactgccacatctgtgagcgcaagttcaagaacgagctggaccgcgaccgccatatgctggtccacggagacaagtggccttttgcctgtgagctctgtggccatggggccaccaagtaccaggcgctggaactgcatgtcaggaagcaccccttcgtgtacgtctgtgccgtctgccgcaagaagttcgtcagctccatcaggctgcgcacccacatcaaagaggtgcacggggctgcccaggaggccttggtcttcaccagttccatcaaccagagcttctgcctcctggaacctggtggggacatccagcaagaagctctgggggaccagctacagctggtggaagaggagtttgccctccagggcgtgaatgcactcaaggaagaggcctgtcctggggacactcagctggaggagggccggaaggagccggaggcccctggggaaatgcctgccccagctgtgcacctggcctccccgcaggccgaaagcacagccctgccaccctgtgagctggaaaccaccgtggtctcctcctcagacccgcattctcaagaggtggtttcagatgattttttgttgaaaaaggatacctcctccgcagaggctcatgctgctcctgagaagcccccagacatgcagcacagaagctcagtccagacgcaaggtgaagtgatcacactactgctgtccaaggcccagagtgctgggtcagatcaggaaagccatggcgcccagagccccctaggggaagggcagaacatggctgtgctttcagctggtgacccagatcccagcaggtgtctcaggtcaaacccagctgaggcctcagacctcctccctccagtagctggtggtggggacaccatcacacatcagcctgactcttgcaaagctgcccctgagcaccggtcaggcatcaccgctttcatgaaggtcctgaacagtttacagaagaagcaaatgaacaccagcttgtgtgagcggatccggaaggtttatggagacctggagtgtgaatactgtggcaaacttttttggtaccaagtgcattttgatatgcatgtccgcacccacacccgggaacatctgtattattgctctcagtgtcattattcttccatcaccaaaaactgccttaaacgccacgtaattcagaaacacagtaacatcttgctgaagtgtcccaccgacggctgtgactactcaactccagataaatataagctacaggcacatcttaaagttcacacagcactggacaaaaggagttattcttgtcctgtttgtgaaaagtctttttcagaggatcgattgataaagtcacatatcaagaccaaccatcctgaggtctccatgagcaccatttctgaggttctcgggaggagggttcagctgaaagggctaattggaaagagagccatgaaatgcccatattgtgacttttatttcatgaagaatggctcagaccttcagcgtcatatttgggctcatgaaggtgtgaagcccttcaagtgttctttgtgtgagtatgcaactcgtagcaagagtaacctcaaggctcatatgaatcgtcacagcactgagaaaacccacctatgtgacatgtgtggcaagaaattcaaatcaaaagggacactgaaaagtcacaaactccttcacactgcagatgggaagcagtttaagtgcacggtgtgtgactacacagcggcccagaagccacagctgctgcggcacatggaacagcatgtctccttcaagcctttccgctgtgcccattgccattactcctgcaacatatctggctctctgaagcggcactacaacaggaagcaccctaatgaggagtatgccaacgtgggcaccggggagctggcagcggaggtgctcatccagcaaggtggtttgaagtgtcctgtttgcagctttgtatatggcaccaaatgggagttcaataggcacttgaagaacaaacatggcttgaaggtggtggaaattgatggagaccccaagtgggagacagcaacagaagctcctgaggagccctccacccagtatctccacatcacagaggccgaagaagacgttcaagggacacaggcagcggtggccgcgctccaggacctgagatacacctctgagagtggcgaccgactggaccccacggctgtgaacatcctgcagcagatcattgagctgggcgccgagacccatgacgccactgcccttgcctcggtggttgccatggcaccagggacggtgactgtggttaagcaggtcaccgaggaggagcccagctccaaccacacggtcatgatccaggagacggtccagcaagcgtccgtggagcttgccgagcagcaccacctggtggtgtcctccgacgacgtggagggcattgagacggtgactgtctacacgcagggcggggaggcctcggagttcatcgtctacgtgcaggaggccatgcagcctgtggaggagcaggctgtggagcagccggcccaggaactctagaggacatgtggcatcggatggccacagggcggggctgccaggctctgcaggcacccagggtggggaggccacccttcctgccctacccgcagaatggtgctctcctttgccctccctgcccagcagcctgataggactctcctagtccaacttggggtgggcaaggcagtcagcatcaccagcaacaccacaggaccctcaccccagcatagacacacaccccctgacccttaccatctgcttcctgaaagacttcagtgtcagctcccctacacacaccccacaccttcaccccttgcttcaagattcaaacagagactcccagtccccctcagcatcttccctgaatcacagccccagctccttgacccccatctaggtgccaaatgttcatctgcaaccgctatgcagtctggtgagagggagacagccatcacatagaaagtgaccgtacgggtttttaatcactgctgggtggggtgggggtagggggattgtcctggctttgtcgacaaagtcccacttccccgagtattaagggcccttggtatcaagtgaggtaaattcacccatcacagggtctcgccctaccatcctggaattatttcacttttaagataaatgcactatttcactgttcgcctcccattctaaggaggtgaggtggttggaataaaaacagttcctgtcaaaaaaaaaaa

SEQ ID NO: 89 - DNA, 6172 bp, Homo sapiens
  CDS (138)..(2777)
ctcgcgaggagagcggagcaggcgcgcggcccaggcggaggagcgccgactctggagcagccggagctggaagaggaggaggaggagaggcggcggggaaggaggaggagggggagagtcgctcccgccgggcgagcatggggcgcctggcctcgaggccgctgctgctggcgctcctgtcgttggctctttgccgagggcgtgtggtgagagtccccacagcgaccctggttcgagtggtgggcactgagctggtcatcccctgcaacgtcagtgactatgatggccccagcgagcaaaactttgactggagcttctcatctttggggagcagctttgtggagcttgcaagcacctgggaggtggggttcccagcccagctgtaccaggagcggctgcagaggggcgagatcctgttaaggcggactgccaacgacgccgtggagctccacataaagaacgtccagccttcagaccaaggccactacaaatgttcaacccccagcacagatgccactgtccagggaaactatgaggacacagtgcaggttaaagtgctggccgactccctgcacgtgggccccagcgcgcggcccccgccgagcctgagcctgcgggagggggagcccttcgagctgcgctgcactgccgcctccgcctcgccgctgcacacgcacctggcgctgctgtgggaggtgcaccgcggcccggccaggcggagcgtcctcgccctgacccacgagggcaggttccacccgggcctggggtacgagcagcgctaccacagtggggacgtgcgcctcgacaccgtgggcagcgacgcctaccgcctctcagtgtcccgggctctgtctgccgaccagggctcctacaggtgtatcgtcagcgagtggatcgccgagcagggcaactggcaggaaatccaagaaaaggccgtggaagttgccaccgtggtgatccagccgacagttctgcgagcagctgtgcccaagaatgtgtctgtggctgaaggaaaggaactggacctgacctgtaacatcacaacagaccgagccgatgacgtccggcccgaggtgacgtggtccttcagcaggatgcctgacagcaccctacctggctcccgcgtgttggcgcggcttgaccgtgattccctggtgcacagctcgcctcatgttgctttgagtcatgtggatgcacgctcctaccatttactggttcgggatgttagcaaagaaaactctggctactattactgccacgtgtccctgtgggcacccggacacaacaggagctggcacaaagtggcagaggccgtgtcttccccagctggtgtgggtgtgacctggctagaaccagactaccaggtgtacctgaatgcttccaaggtccccgggtttgcggatgaccccacagagctggcatgccaggtggtggacacgaagagtggggaggcgaatgtccgattcacggtttcgtggtactacaggatgaaccggcgcagcgacaatgtggtgaccagcgagctgcttgcagtcatggacggggactggacgctaaaatatggagagaggagcaagcagcgggcccaggatggagactttattttttctaaggaacatacagacacgttcaatttccggatccaaaggactacagaggaagacagaggcaattattactgtgttgtgtctgcctggaccaaacagcggaacaacagctgggtgaaaagcaaggatgtcttctccaagcctgttaacatattttgggcattagaagattccgtgcttgtggtgaaggcgaggcagccaaagcctttctttgctgccggaaatacatttgagatgacttgcaaagtatcttccaagaatattaagtcgccacgctactctgttctcatcatggctgagaagcctgtcggcgacctctccagtcccaatgaaacgaagtacatcatctctctggaccaggattctgtggtgaagctggagaattggacagatgcatcacgggtggatggcgttgttttagaaaaagtgcaggaggatgagttccgctatcgaatgtaccagactcaggtctcagacgcagggctgtaccgctgcatggtgacagcctggtctcctgtcaggggcagcctttggcgagaagcagcaaccagtctctccaatcctattgagatagacttccaaacctcaggtcctatatttaatgcttctgtgcattcagacacaccatcagtaattcggggagatctgatcaaattgttctgtatcatcactgtcgagggagcagcactggatccagatgacatggcctttgatgtgtcctggtttgcggtgcactcttttggcctggacaaggctcctgtgctcctgtcttccctggatcggaagggcatcgtgaccacctcccggagggactggaagagcgacctcagcctggagcgcgtgagtgtgctggaattcttgctgcaagtgcatggctccgaggaccaggactttggcaactactactgttccgtgactccatgggtgaagtcaccaacaggttcctggcagaaggaggcagagatccactccaagcccgtttttataactgtgaagatggatgtgctgaacgccttcaagtatcccttgctgatcggcatcggtctgtccacggtcatcgggctcctgtcctgtctcatcgggtactgcagctcccactggtgttgtaagaaggaggttcaggagacacggcgcgagcgccgcaggctcatgtcgatggagatggactaggctggcccgggaggggagtgacagagggacgttctaggagcaattggggcaagaagaggacagtgatattttaaaacaaagtgtgttacactaaaaaccagtcctctctaatctcaggtgggacttggcgctctctcttttctgcatgtcaagttctgagcgcggacatgtttaccagcacacggctcttcttcccacggcactttctgatgtaacaatcgagtgtgtgttttcccaactgcagctttttaatggttaaccttcatctaattttttttctcccactggtttatagatcctctgacttgtgtgtgtttatagcttttgtttcgcggggttgtggtgaggaaggggtgatggcatgcggagttctttatcttcagtgagaatgtgcctgcccgcctgagagccagcttccgcgttggaggcacgtgttcagagagctgctgagcgccaccctctacccggctgacagacaacacagacctgtgccgaaggctaatttgtggcttttacgaccctaccccaccccctgttttcaggggtttagactacatttgaaatccaaacttggagtatataacttttttttgagcccaactgctttttttttttttttttttgcttctctgccccttttccatttcttttgtatttgttttctgtgagagcactgaaatggcagccctggaatctacaatttggctctccactgagcaccttatcttgccaccttagccttaagaatgaatatgaagaaaaatacacagccacctctgtccagggcagtaagaagggctgcaaggaaggggaggatggggacaaggaaaggatcagatacctgctccagtagttgtgaggccactgtgtctcaggggactccaggaggagcagaagagggatcccacgaagttattcttacgcagctggggccaggagggtcagagtggtgccaggtgcaagttaggctaaagaagccaccactattcctctctcttgcccattgtggggggcaaaggcattggtcaccaagagtcttgcagggggacccacagatatgccatgtccttcacacgtgcttgggctccttaacctgaaggcaaattgctacttgcaagactgactgacttcaaggaatcagaaattacctagaagcaccatgttttttctatgaccttttcagtccttcaggtcattttaaggtccactgcagggggttagtgagaaagggtatactttgtggtatgttttgctttcctaatagggacatgaaggaaacccagcaatttgctgttatgtgaatggcctgtagagcagagtcaagagcggtgtgctttgcccgactgctcccatcaggaataggagagtagacagagatcttccacatcccaggcttctgctgctgctttaaaagctctgtccttggagcctcccgctccctgaagtgtctcgccccctgcacagcactggcctttcggaagcatcccagtagggttttctgaggctcgctggtgactcatgccctaattgcaatcctctgcttttatcttgactttgaaggatctaacactgctctctcttccaaaggggaaaaaaagattcatttgttttgagcaataaactaatacaaaatgatggccattcatgtgcagctctttgtcaccatgggccggatgagttgtgctcctcctggctcaccatttccccctgctcccccacagccggttctgcacttatcaccgagtcgcccctggaagcagattcccattgagttttccccaccaaggggaccatgcacatggtagaaacattagattctgcattgacagtagcctttccttggcccgggcctgtggtgggaagacgggcaacaagtataccccaccagggcctgagtgactagaggaagaggacgaggccttgttggcactagatttgggtattttctgcatgtcataacatatcctaactgctatttcagaagaggcagcttgtaggtgattgtacaagtgagaattaaagagagaacaaatatttaaacaggtgctgtattagtaacagccagtgccctttcagcccttgcatctattaaaaggagattcaggattttattggcacaggcccttcttagtaggaagaaagggtgcttagctttggacctgaccgggtgtgtgtaaaaccatggactgagtcacagcagacactcgatggtggtaaatgtgatgggtgcttacacactgtaccttttcctttcatactgatgctgcagttcagggctggagttgttaaggcattgacctccacccacctgccccatgtccactgggctgcccaagctgcatgtcacctgagggctggcaggaaggggcgagaaatcccagggcattgtaccaaggacctagttccttctagggatataaatttccaggaatgtgtatttttaatgtggtgagatgcactcttttgttgtaccaaatagggctccccaccccacccctgcgacaagtgctcttctagaacaggttcctaccagcagcactggtgtgaatgaaagagagacccagccgcgtctcacacaggtggaattgcacttcttaacaaaaaggaactttataaaagtttgggattttttttcctaatcataaaaatagccccagaaagagcctaagctatgttcagatagaagcctcgaaattcctgtaaattgtttactttatgatgtttacatacacgtttcactttgaaaaaaaatgcaaatcgactttttaacaactgttgagatgtttcatgggacagtagaactctgactcaccaactgggctaaattttaatttaaaaatgtatttatttgagtgtctttccccccctcaccctcaccatctgaggggctccctgagatcttggtagaggaggcccctcctgcccagaccttcgtttgtttccccggtggcccttgcttcttgctttgcagactgcctgcagccatgattttgtcactgacatctgtgagccaaagactgagcctttttggcaggaataataagcaatactacacaacttgctactttcagaaaacttttttttagcttcaccgatgacaacagaggaagaagggaactgggatttgggtaagttctcctccactgtttgaccaaattctcagtgataaatatgtgtgcagatccctagaagagaaaacgctgactttctttttaagtgtggcacataaggatctgcagaattttccgtagacaaagaaaggatcttgtgtatttttgtccatatccaatgttatatgaactaattgtattgttttatactgtgaccacaaatattatgcaatgcaccatttgttttttatttcattaaaggaagtttaatttaaaaaaaaaaaa

SEQ ID NO: 90 - DNA, 1192 bp, Homo sapiens
  CDS (1)..(669)
atggaagaccaaaatgcattgcacatcattgagaccatcaaaagacatgtctatgaattgcccaggagcccccaaaggggtcctccgcggccccgcccctttacgtgcggccccgccccttggcgtggcgccctgacaaatggcgccggaagccccgcccccggccggttgctaggctccgacagccggaagtcccgcctgccgtgtagtcgccgccgtcgctgccgctgccgctgccgccgtcgttgttgttgtgctcggtgcgctgagctccgcggctccgcgagccggttccgtccccttcccgccgccgccatgaagtggatgttcaaggaggaccactcgctggaacacagatgcgtggagtccgcgaagattcgagcgaaatatcccgacagggttccggtgattgtggaaaaggtctcaggctctcagattgttgacattgacaaacggaagtacttggttccatctgatatcactgtggctcagttcatgtggatcatcaggaaaaggatccagcttccttctgaaaaggcgatcttcctgtttgtggataagacagtcccacagtccagcctaactatgggacagctttacgagaaggaaaaagatgaagatggattcttatatgtggcctacagcggagagaacacttttggcttctgagggccattgctgggctaggtgcaccgtaactgcttgtgtatcttgtaaatagccagccattttcagttattataccagaacctcttcacatagacctattagtgcatttgtaactggatttatttcttaatatattggaaggttttgtttccttagactagtaaattatcatacagagttttattttgagtttttctttttgtgcattgtcctcatgcctgtattctccaggaaacttgtccttctggaaatcatattgaatgatatttctatatcgaagtgaggtaggtgcggtattaaagtgaaagggaaggtgatgcatttattctgggttatgcttgaagtgttagatggctaagtattaaaattatccaaattaaatccttagcagtcagaacacttgcttcactagaatatgccaactgccaatcatgttggactgagctaatttgttcctctttctgaaactattaaggtaaataattaacaataaaaattctcttataaaggcaaaaaaaaaaaa

SEQ ID NO: 91 - DNA, 6224 bp, Homo sapiens
  CDS (1)..(3597)
atggccacagctcatctgcatgaaatagatgcaggtgtaattgagtttccttggaacagagcattggctagctggctggctggcacgcttgctatgatgactcagatgcaaagcatgttgctaatttgtcctcctgttactcggttcttctatggatgcagagaatatttccataaactgttaattcagggtgattcttctggaaggttgaatatttggaacatatcagacacagctgataaacagggaagtgaagaagggctggcaatgacaacttctattagtttgcaagaggcatttgataaactgaatccttgtcctgctggaattatagatcagctgagtgtgattcccaatagtaatgaacctcttaaagtaactgcaagtgtgtacataccagcacatggacgacttgtttgtggtcgtgaagatggaagcatagttattgtacctgccacacagacggccatagtacagctgttgcaaggggaacacatgctcagaagaggttggccacctcacagaacactccgtggtcatcggaacaaagtcacatgtttgctatatcctcatcaggtctcagctcggtatgatcaaagatacctgatatctggaggtgtggatttttcagtcataatttgggacatattttctggagaaatgaaacatatcttctgtgttcatggtggtgagattactcaacttctagttccacctgaaaactgtagtgcaagagtacagcactgcatctgctctgtagccagtgaccactcagtaggacttctaagtttgcgagagaaaaaatgcataatgttggcatctcgtcacctttttcctattcaagtaatcaaatggaggccttctgatgattacctggtggtggggtgttcagatggttctgtgtacgtctggcaaatggatactggtgcattggatcgttgtgtgatggggataacagcagttgagattctaaacgcttgtgatgaagctgttcctgctgctgttgattcacttagtcatccagcagtcaacctaaaacaagctatgacgagacgtagtcttgctgctcttaaaaatatggcccatcataagctacaaacccttgcaactaacctcttggcttctgaggcatctgacaagggaaatttacctaaatattctcataactccctgatggttcaagcaataaagacaaacctaacagacccggacatacatgtgctattctttgatgtggaagcgttgattattcaactcctgactgaagaagcctctaggccgaatactgctcttatttccccagagaatttgcaaaaagcatctggcagttcagacaaagggggctcttttttaactggaaaacgagcagcagttctcttccaacaagtgaaagaaacgatcaaagagaacatcaaggaacacctccttgatgatgaagaggaggatgaggagataatgaggcagagaagggaagaaagtgatcctgaatatcggtccagcaaatcaaagccattgaccctattagaatataatttaactatggacactgcaaagctgtttatgtcctgccttcacgcctggggtttgaatgaagtactggatgaagtttgcctggatcgccttggaatgctgaaaccccactgcaccgtatcgtttggcctcttgtcaagaggaggccatatgtcactgatgctgccgggttataatcagcctgcttgtaaactgtcacatgggaaaacagaagtaggaaggaagctgccagcgtctgagggagtaggaaagggaacttacggagtgtcccgtgccgtcaccacacagcatctcctgtctatcatttctttggcaaatactttaatgagtatgaccaatgcaacttttattggtgatcatatgaagaagggtcctaccaggccacctagaccaagcaccccagacctttctaaggcaaggggttcccctccaacttccagtaatattgtgcaaggacagattaaacaagttgctgcacctgtcgtttccgctcggtctgatgctgatcactctggctctgaccctccttctgctcctgctttacatacctgtttcttagtaaatgaaggttggagtcagttagctgctatgcactgtgttatgctgccagacctactgggattggataaatttaggcctccccttctggagatgctggcccgaagatggcaagatcgatgcttggaggtgagagaagccgcacaggccctgcttctggcggaactgagaagaattgagcaggcaggcaggaaggaagccattgatgcctgggctccttacttacctcagtacatagaccacgtcatatcacctggagtcacatcagaagccgcgcagactatcaccacggctcctgatgcctcagggcctgaagcaaaagtccaggaggaagagcatgaccttgttgacgatgacatcaccactggttgcttatcaagtgtcccacaaatgaaaaaaatttctacatcttacgaggaaagacggaagcaagctaccgctattgttttacttggagtaataggagctgaatttggtgctgaaattgaacctcctaaactattgaccagacctcgaagctctagccaaattcctgagggattcgggttgactagtggtggatccaactactcgctggccagacatacttgcaaggcactgacgtttcttctgctacagcctccaagccccaaacttcctccacacagcactatccgaagaacagccattgatctgattggacgtgggttcactgtttgggagccttacatggatgtgtccgctgttctgatggggcttctcgaactttgtgccgatgccgagaaacaacttgccaacatcacaatggggttgcctctgagcccagcagctgactcggcccgctctgcgaggcatgccctctcgctcattgccaccgccagaccacccgccttcatcaccaccatagccaaagaggtacacagacatacggctcttgcagcaaatacccaatcacagcagaatatgcacacaacaactcttgcacgagctaaaggggaaattttgagagtcattgaaattcttattgaaaagatgcccacagatgttgtggatcttctcgtggaggttatggacatcattatgtactgccttgaaggatctttagttaaaaagaaaggtcttcaagaatgtttcccagccatctgcaggttctacatggtcagctattatgagcggaatcacagaatagcagttggagctcgccatggttcagtggccctgtacgacatccggactggaaaatgtcagacaatccatggacacaagggaccaatcactgcagtggcttttgctcctgatggaagatatcttgccacctactcaaacactgacagccacatttctttttggcagatgaacacgtcactgctgggaagcatcggcatgctgaactcggcacctcagctgcgctgcattaaaacctaccaggtgccccctgtgcagcccgcgtcccccggctcccacaatgccctcaagctgggcccggctcatctggacttccaaccgcaacgtcatcctcatggcccatgacgggaaggagcaccgcttcatggtctaatgctgctgcctgccgccgtgactgcgttttagttctctaaattatccaagccgatgttgctctgtccttcctcacaccagattgttcccaggggcctgcccaccccagtgccatccagtggcacggccggccgggtcttgtcacttgtgcatgcttctcaggggcagaacccgctcgtgccatctgtcgattcagaggcacgcacacatgctctgcaggatgtggccatcctgtcaccaggtagtttttccctgccagagatggcaggggaaagccagcggttcctgggaacgctcttgttgcttggtgcaacagaagcacaaaaatcaataaacactgtgattgcactcccagcccagatcagcatttttagccatctcaaccgcacctctgaagtgctgcttgaatctggccgttctgacactgggtgttgaggtcatgtggcagtcctcacgattgaaattattgccctttgaattacctaaaatattgtttaccaaaaagattctgtgtttacatgttcttttcttctggtgattgctaggaaattactcaatccaatttcctagggtttagctaccaccttctttatcaacagctaaccaatttgagattcatgattaattatgtacacaaaaatattttccttgtagaaaatagttttccagacacttagccttctgaagtgctcatctcttgcttaaatgatagtctatttagtagtttaaaataaaaataatcactccctatgatctagttaatgtaattatccagtcactgtaactaatctcttgaagggacttttgtgataaagagccaagttcagaagcatagcgtgtaccgaaaatgaagactctcctatctactgctacagatcctgttgaagaaagagcttacccctttcccccggaaaacttgcaatcctgtagttcccatatgtgtggcatatgtcagttatgaaattattataattcagccttcaaactactactgatcaactaaaggaaagctaataaggtatttcttttaaacaagtattctggaaaagtaataactatggcacaaatgttcaggagtgtatataaaaatatgtgggctctcgatttatttgagcaaacattgcaatgagggtgttcattatgcttctaagtaagctttaactagaccactttcttcttatgtcagattgtgctggttctagctcataataatgaaaaaaatagaattatattttgtatgaattgtttctaacaaaccttgatctgtatatacttgtgaggggttgtttggttgcctaattgttgattggttggttagttgggcaaaatcatttattacatgcaaaaatagaaaattatttgttaaattcagagaaaatatgtgaagtttacaaaggaaccaaaatgataatgggagaatttagtcttaaaagtttaggttgtcagagtttatctgatatacaaaaaagtaggatcaaagtctaggaacaaacattggttatttcactgaaacagatttttaaagagcatattaagaaattaagaccattagatcatctctttcataatgatatgatgttatttccattgacggcaaatctatactgttccttggttttagagttgggtattctttcaaaagtgaatttaggcacatgcatgtacattgtatttataaagattatatatgtagtttccaaggaagaaacaaagacctatacagtttagactttatttgtttggtgaacgtgctgttgtgtttggcatagctagagaaatgtaaggtaaaaggctcactttgttttccagtgggtccagagtcttctctatacccaacatatgtttactttatgaacttaaatggaaattaatttattgtagactacatctctatttggaatgatgaggtaaatgtataccttagcattttctttaacaaaaatgttctgtgtgtcaggaaagaggtgtgagagcggtaggcagcctgccgcaaacacacggatggctcccaccgccacgaaggttgagaacaaagccagggggcccagaggagcaatagccctgggccacaagcgtgggtaggcctttcacgtattccgtctgcacaggcaaccaaggccagtagaaagctatggctgcaaaaccctggggtggacgatgtttgatgattagacggtcatctctaactactaaactaatatctgcattcttgttaacataaatctctccttggctattttaatagccacagtcccaaacttcatcccagcttagatttctcagcactgaggtaaactctgcattgtcatcccagcgtacacctttaatgttttattgatttcactggcactgtatttggacctgtccttgtatatgtagagacatatgtggcttcattggtaatttacaagcaaaagatgacatgacgtgacacctgtatgaaaatgtgatgattgaactccctgtgtacagcgagtgaattaaaatgtctgcctctccagacatttcttaatgattccacttaatagactctatgtgtgctgaatgttcctgtgtacatatgtgtgttaaataaaacaattgtattgaaaaaaaaaaaa

SEQ ID NO: 92 - DNA, 667 bp, Homo sapiens
  CDS (97)..(603)
gcacgaggtcgcgggggcgggctcgggaaagaccgtgccagcggcgtgtggcgcgggtttcgcacggtccaataagggagggcggcgtggccggccatggtagcgacgaggacgcgcctgcgcagaggcggcagcaccaccggggttgactccgggggcgcggcgaggagagacatgaggctgagctggttccgggtcctgacagtactgtccatctgcctgagcgccgtggccacggccacgggggccgagggcaaaaggaagctgcagatcggggtcaagaagcgggtggaccactgtcccatcaaatcgcgcaaaggggatgtcctgcacatgcactacacggggaagctggaagatgggacagagtttgacagcagcctgccccagaaccagccctttgtcttctcccttggcacaggccaggtcatcaagggctgggaccaggggctgctggggatgtgtgagggggaaaagcgcaagctggtgatcccatccgagctagggtatggagagcggggagctcccccaaagattccaggcggtgcaaccctggtgttcgaggtggagctgctcaaaatagagcgacgaactgagctgtaaccagactggggaggggcagggggagaggcccccatcagggaccagactgttccaaaaaaaaaaa

SEQ ID NO: 93 - DNA, 2094 bp, Homo sapiens
  CDS (490)..(2052)
aaaataactacagcaaggtgttctttagcaaaagtttgacaaccacagacttaagcatttaatacagatgcatgagtcatgagtgcaagcttttacatacttgttacaactttatttccttagtatttcattttcctaacttgtatctgtgtgctagtgtttgtttaggcattagtgtaatgtatttatataaacattcttttttaagctgaagcatttgatttgattgcacaagatgaagaagaatttaataaagagcatcaatttatacaggaagaaaacatagatgctcataatacttcggttgcactgggcgatacgtcctggggagctacaattaattacagtctgttgaggaaatcacgtagcacatcagatttggataaagatgatgccagttatttacgtctgtctttaggagagttctttgctcaaagatctgaagctcttggttgccttggtggtggtaacaatgtgaaaagagtaagtatggaatctgttggaagtgctcacagtcaccagattttagattttgagtattatgatggcacaccatcatttggctattttattagatcaccagagaagagagaacctattgccttaataagaaaatctgatgtatcaagaggtaatttggaaaaagaaatggctcatcttaaccatgatctatattcaggagatttaaatgaacagtcccaggcacagctaagtgaaggatcaattacacttcaggttgaagcagtagagagtacttcacaagtggatgaaaatgatgtgacgttaacggctgataaaggcaaaacagaggacactttcttcatgagcaacaaaccccaaagatacaaagacaagctaccagatagtggtgattctatgcttaggatcagcaccattgcttcagccattgcagaggcatcagttaatactgatccttcccaacttgctgcaatgatcaaggcactttcaaataaaaccagagacaagacttttcaggaagatgagaaacaaaaggactattctcatgtgcgtcatttcttacctaatgatttagaaaaaagtaatggatccaatgcacttgatatggagaaataccttaaaaaaacagaagttagtagatatgaaagtgcattggaaaacttttcaagggctagtatgtctgatacttgggatttatctttgcccaaagaacaaactactcaagacattcatccggtggacttaagtgctactagtgtaagtgtgagggcaccagaagaaaacacagcagctattgtttatgttgaaaatggagagagtgagaatcaagagtcatttagaaccataaactcctcaaattcagttacaaatagagagaataacagtgcagtagttgatgtgaagacatgttccattgacaacaaattacaagatgttggtaacgatgaaaaagctacctcaatttccactccatctgatagttattcatcagtgaggaaccccagaataacatccctttgtctgttaaaagactgtgaagaaatacgagataacagagaaaatcagaggcaaaatgagtgtgtcagtgaaataagcaacagtgagaagcatgtgacttttgaaaaccatcgcatagtctcacctaaaaatagtgatttgaaaaatacctctcctgagcatggtggacgtggctcagaggatgagcaggagagcttcagaccttccacgtcaccactgagtcattcttctcctagtgaaatttctggaacgagttcatcagggtgtgcgttagagtcctttggttcagcagctcagcagcagcagcctccctgtgagcaggagttgtctcccttggtgtgctcgcctgctggggtgagcaggctgacgtatgtgtctgaaccagagagctcctatcctaccacagccacagatgatgccctggaggaccgcaaggtgggcagccacttggattatttattactaaggctttcaactcttaaaagtgttaacagatgtttgattcagactacagttcaagcctatataacttcagtgttgctcttttatctttaaaatgatttttgtatttgtgtgcacatattaaatacctactca

SEQ ID NO: 94 - DNA, 2662 bp, Homo sapiens
  CDS (52)..(1950)
agtagtgataaatttaaagagacttcagaagttttagaacggaaaatatctatgcgaaagccaagagaagagctggttaaaagaggggttctgttggaagaccctgagcaaggtggtgaggatccaggaaagccaagcgatgccatgttaaagaatggccataccacccccatagggaatgccagatcatctagtccagtccaagtagaggaagagccagtaagattagcaagtcttaggaaagctattccagaagaggacctaaagaaacgactaggctcaactggaagccagcctaattctgaagcagagtctgttcctgagaatgtacccaaaccacctttacttcctcccaaaagacccttgtcctcttctcatgaagcaagtgaagggcaagcaaaggatgccacttcctctggcggcacggcaaggttcatcatctccacctccatcaccacagcacccgctgccaccactgctgccacaagccttgcaaagactgttaatctctctgtcaccccttccccagcacccaggactctgcctgctgctcctgccagcactaacactactgctaccccaagcctcactcatatggtccctgccaagcagccccctatccctccccctaaaccagctcacagaaatagcaaccctgtcattgctgaactgtcccaagcaataaacagtggtacattgttatcaaaaccgtccccacccttaccacctaagagaggcattccatcaacctcagtacccaccttggagtctgctgctgccatcaccacaaaaacaccaagtgatgaaagagagaagagcacgtgttctatgggctcggaactactaccaatgatctcacctcgctctccgtcccccccactgcctactcatatacctccagagcctccacgcacccctccattccctgctaagacttttcaagttgtgccagaaattgagtttccaccatccttagatctacaccaggagattccccagcaggaagatcagaaaaaggaagtccccaagaggatactggaccagaactttggggagccccatataccctctaggctgcctccactcccactgcatattcgaatccagcaggccctcaccagcccacttcccatgactcctattctggagggttctcacagagctcattcgttgctttttgaaaacagtgacagcttttctgaggacagcagtacgctgggtcggaccaggtctcttcccatcactattgaaatgctaaaagttccagacgatgaagaagaagaggagcaaacctgtccatccacattcagtgaagaaatgacacctacctcagtcattcctaaattaccacagtgtctacgggaggaagaagagaaggagagcgactctgattcagaaggtcccattcagtaccgagatgaagaagatgaagatgaaagctatcagagtgctctcgccaacaaagtgaagaggaaagacacactggcaatgaagttgaaccacagacccagtgaaccagagttgaacctgaattcttggccttgtaaaagcaaggaggagtggaatgaaatacggcaccagattggaaacacactgatccggcgactgagtcaaagaccaacaccagaagaactagaacaacgcaatatattgcaacctaaaaatgaagctgatcgtcaggcagaaaaacgagaaattaaacgtcggctcactagaaagctcagtcaaaggccaactgtcgctgaactccttgccaggaagattctgaggtttaatgaatatgtagaggtaacagatgctcaagattatgaccggcgagccgacaaaccttggaccaaactgacccctgctgacaaggctgccataagaaaagaattaaatgaatttaaaagctccgagatggaggttcatgaagagagcaaacattttacacgctaccatcgtccatgatgccaaaggttgagagaggaatcaacatggctgctttgctgcttccttctccaaagtgacatatggagggaactttagcacttcccagcacagccagaattgcatcctctgggatcttctgaggtggacagcactttgaatgtagcatttcactggaacagagtcttatgtgctgcaccgggggcaaaacaacactttgtcagtgcttttgaacctttcaatattgtagcatgcttgaggagtttttcccttactggccaccaaagttctgaaccacttgcaggttccaggttttactggctgcaccacaccccttcccctagatgactgcctgtgcagagacacagtttgcaccattagccttacctgccctgccctgattgtgagacccaaatgtgtaggctctaaattccagccatcaaatccaattcctggtggggaaaaccttctggagacccccaaccttctgataaaagagtctctacctccagggaaagccttcttaccacactggcatatcagatgaaagcattgcactgtacctctcgtaacacagcaatacagtcctcttgaggcactcaagcctgagaggaagctcaggatctgacatgttcttccttttcctcacaagtcatcatgattttttattttaaaataatctggaagtaatgggaacttagtttttcctgaactccaaccagaatccaaattg

SEQ ID NO: 95 - DNA, 2852 bp, Homo sapiens
  CDS (60)..(2819)
tttcgttgggatcccctcgggctcccgccttagcatgctggccgggacatctggtgaacatggcctctgctactgcggcagcagcacgacggggcctcggccgggctctccctctcctctggcgtggctaccagaccgagcggggcgtttacggctaccggccgaggaagcccgagagccgcgagccccagggcgccctggagcgccccccagttgatcatggccttgccaggttggtgacagtatattgtgagcatggtcataaagctgccaaaatcaaccccctcttcaccggacaagccctgctggagaatgtgcctgaaatccaagccctggtgcagacactgcagggacccttccacacggcaggattattgaacatggggaaggaagaggcctcacttgaggaagtgttagtctatctcaatcaaatctactgtgggcagatttctattgaaacctcccaacttcagagccaggatgagaaagactggtttgccaagcggtttgaggaactgcaaaaggagacgtttaccacagaagagcgaaaacatctgtcgaaactaatgctggaatctcaggagtttgaccactttctggccaccaagttctcgacagtgaagcgatatggaggcgaaggggctgaaagcatgatgggctttttccacgagctgctgaaaatgtcggcctacagcgggatcactgatgtcattattgggatgccccatagagggaggctgaatttattgacaggccttctgcagttccctccagagctgatgttccgtaaaatgcgaggcttaagtgaatttccagagaatttctcagccactggagacgtcctgtctcacctgacctcctctgtggacctggactttggggcgcaccatcccctccatgtgacaatgttgcccaatccctcgcacctggaggccgtcaaccccgtggccgtgggcaaaactcgcggcaggcagcagtctcgccaagacggcgattactctccagacaactcagcccagccgggggacagggtcatttgcttacaggtccatggtgatgcttctttctgtggtcaagggattgttcctgaaacattcacgctgtccaatctcccacatttcagaattggtgggagtgtgcatttgattgttaataaccagctgggttacaccactccagctgaaagaggaaggtcttctttatactgcagtgatattgggaagcttgtgggctgtgccatcatccatgtcaatggagacagcccagaggaagtggtccgtgccacacgactggcttttgaataccaacgccagttccgcaaggatgtgattattgatctgttgtgctacaggcagtggggccacaatgagctggatgagccattctacaccaaccccatcatgtacaaaatcatcagagctcgaaagagcattccagacacatatgcagagcacctcattgctggcggactcatgacgcaggaggaggtgtctgaaataaaatcctcctactatgccaagttgaatgatcacttaaataacatggcccactacaggccccctgccctgaacctgcaggcccactggcagggcctggctcagccagaagcgcaaatcaccacctggagtacaggtgtgcccctcgacctcctgcggtttgttggcatgaagtctgtagaggtgccaagagagctgcagatgcacagtcacctgctgaagacacatgttcagtccagaatggagaagatgatggacggaatcaagctagactgggccaccgcggaagctcttgccttgggttctttacttgctcaaggttttaatgttcgtctaagtggccaagatgttggtcgtggaactttcagtcagaggcatgcaatggtggtttgccaggagacggatgacacctacatccccctgaaccatatggacccaaatcagaaggggtttctagaggtcagcaacagccccctgtcagaagaggccgtcctgggattcgaatatgggatgagcattgagagcccaaagttactgcccctgtgggaggcacagtttggcgatttcttcaatggtgcccagatcatctttgacacattcatctctggaggagaggccaagtggctcctacaaagcggcattgtcatcctccttccacatggctacgatggggctgggccagaccactcatcctgtcgaatagagcgtttcctgcagatgtgtgacagtgcggaagagggggtggacggagacactgtgaacatgtttgtggttcacccaacaactcctgcacagtatttccacttgcttaggagacagatggtccggaacttcagaaaaccactcattgttgcttcccctaagatgttactcaggctcccggcagccgtgtcaactcttcaagaaatggcaccaggaacaacatttaacccggtcattggtgattcatctgtggatccaaaaaaggttaagaccctcgtgttctgctccggcaaacatttctactccctggtgaaacaaagagaatctctgggggccaagaagcatgactttgccatcatccgagtagaggaactctgccccttcccgttggattctttacagcaagagatgagcaaatacaaacatgttaaagatcatatttggagtcaggaggaacctcagaacatgggtccgtggtcgtttgtttctccaaggtttgaaaagcagctggcctgcaagctccgtctggtgggccggccccctttgccagtacccgctgtaggaattggcacagttcacttgcaccagcatgaagatatcctcgccaagaccttcgcttgatgatgacttttgaagaaacactatttctcttta

SEQ ID NO: 96 - DNA, 2728 bp, Homo sapiens
  CDS (1)..(2259)
atgatttacaccaagggagcccccaacagctacccccctgttttcactgctccttctccgcaactgtgggtggatgggactgttaagcccatgggcatcttctctgaggaattaaggaggggtattggtgaagggttgagagcctgggtctggcaggtgctggctgtctggtccctccacctctgtaacccttcttgtggaggagtgaccggtgagctgctggttctggcagtcacaaaactgggaacccgggcacaggccatggtcacacagcccaccctcagctttactttctccattggctccggccctagcaggcatgtgagtgtgcacctcctactctgggcccagaattcctggagcttttactccttatcaaaccttaaagcccttatgggcttttctgtgcccgtgtctggggctggccagggcccccagaagtacagcctgcacccagcaccaatgaccaccctcacgtgttggtctctaaatttggtgcccaatatagaggaggcagaggcagataaacatggtggtgttgaagtaccctggtctgtgtggccctggaatgccaagaagcatgtgcggctgcgtgagcatgcagccacactggaggaggagctggccctcagccgacaggccacagagccagccccagcactgaggatcgactacccgaaggcactgcagatcctgatggagggcggcacacacatggtgtgcacgggccgcacgcacacagaccgcatctgccgcttcaagtggctctgctactccaacgaggctgaggagttcatcttcttccatggcaacacctctgtcatgctgcccaacctgggctcccggcgcttccagccagccctgctcgacctatccaccgtggaggaccacaacactcagtacttcaacttcgtggagctgcctgctgctgccctgcgcttcatgcccaagccggtgttcgtgccagacgtggccctcatcgccaaccgcttcaaccccgacaacctcatgcacgtctttcatgacgacctgctgccactcttctacaccctgcggcagtttcccggcctggcccacgaggcacggctcttcttcatggagggctggggcgagggtgcacacttcgacctctacaagctgctcagccccaagcagcctctcctgcgggcacagctgaagaccctgggccggctgctgtgcttctcccatgcttttgtgggcctctccaagatcactacctggtaccagtatggctttgtgcagccccagggcccgaaggccaacatcctcgtctcaggcaatgagatccggcagtttgcacggttcatgacagaaaagctgaacgtgagccacacaggagtccccctaggcgaggagtacattctggtctttagccgaacccagaacagactcattctgaatgaggcagagctgctgctggcactggcccaggagttccagatgaagacagtgacagtgtccctggaggaccacacctttgctgatgtcgtgcggctggtcagcaatgcctccatgctggtcagcatgcatggggcccagctggtcaccaccctcttcctgccccgtggggcaactgtggtagagctcttcccatatgctgtcaatcccgaccactacactccctataagacgctggccatgctgcctggcatggacctccagtatgtagcctggcggaacatgatgccagagaacacagtcacacaccctgagcggccctgggatcaggggggcatcacccatctggaccgggctgagcaagcccgtatcctgcaaagccgtgaggtcccacggcatctctgttgccggaaccccgagtggctcttccgaatctaccaggacaccaaggtggacatcccatccctcattcaaaccatacggcgcgtggtgaagggccggccaggaccacggaagcagaagtggacagtcggcctatatccaggcaaggtgcgggaggcacggtgccaggcgtcagtgcatggcgcctccgaggcccgcctcactgtctcctggcagatcccatggaaccttaaatacctgaaggtgagggaggtgaagtacgaggtgtggctgcaggagcagggggagaacacctacgtgccttacatcctggctctgcagaaccacaccttcactgagaacatcaagcccttcaccacctacctggtgtgggtccgctgcatcttcaacaagatcctcctgggaccctttgcagatgtgctggtgtgcaacacgtagcgagcaggccacagcctggcctcgggaaggtggctcctgcagttcagcgtccctgggcccattaatcccactgtggagacttctgggaactatttattgagcaggcctgtgcctccacatcatcttgttgtctctggggtgtggtgtcacagcactcctctttgccctagagataagggacctgacttccccttctcccatcctgaacatttgtacccctggagaagttccttagcagggaggaggaagaggagaggaggaagcaaagaatcacaaggaacctctggctaggtgatcctgatgtttcctactgagtttttctggtatccagatttctggaaaccgagtaatcatgtactgtttgattgggtggttcatctgcttccatcccagtgaaatttacctgtagcccagtgaagggtgtgtttggaacattcattaaatgattctaagcatcaaaaaaaaaaaa

SEQ ID NO: 97 - DNA, 2698 bp, Homo sapiens
  CDS (310)..(2241)
tttcgtgcggctctggcggtcgtggcggtcggagatccgagagctctgcttctctgaaaagcgtgtggctttctggacttggtctacacctgacagtcactggaatgctactccaggccttagaagaaagtgaaactaattttaaaggccccttattctttctgttacctgcctgctgaagtgaaaataaatctccctgctcctttattctaaactgattttactttcccatctcaaaaacgtgtgcagggagcaggagccctcctacccgagccccagctgtattggaaaccctcctaagtcagagtgatgggtcaggaatctagcaagcctgtatggcccaatccaacaggagggtatcagtccaatacaggtaggaggtatggaagaaggcatgcttatgtcagtttcaggccacccacgagccagcgggaaaggattgccagccagagaaagacgaactccgaagtcccaatgcacagatcagcccccagtcaaaccaccaagaggagccgatcgccattttccactactcgtcgtagttgggacgacagcgagagttcgggaaccaacctgaatattgataatgaggactattccaggtatccgccaagagagtacagagcttcgggtagcagaagaggaatggcctatggacatattgactcttatggggcagatgatagtgaggaggagggggctgggcctgttgagcgaccgccagtgagagggaaaactggcaagtttaaagatgataagctgtatgacccagagaaaggggcaaggtctttggctgggccacctccacatttctctagttttagccgtgatgtgagagaggagcgagacaagttagacccagtccctgcagcaagatgctcagctagcagagctgacttcctgccacaaagtagtgtggcctcacagtcgtcttctgaaggcaagctggctacaaaaggtgacagctcggagagggagagaagggagcaaaatttacctgcacgtcccagcagggctcctgtgagtatttgtggtggtggggaaaacacctcaaagagtgcagaggaacctgtggtcaggcccaaaatcagaaacctggcaagtccaaactgcgtgaaaccaaaaattttttttgatactgatgatgatgacgatatgccacacagtacttccaggtggagggataccgccaatgacaatgagggccactcggatggcctggcaagaagagggagaggcgagagttcaagtggctatcccgagccaaagtaccctgaagacaaacgggaagcgaggagtgaccaagtgaaaccagaaaaggtgccgagacgacgacgcaccatggccgaccctgacttctggacgcacagtgatgattactacaaatactgcgacgaagactctgacagtgacaaagagtggattgctgctctgcgtcggaaatatcgaagccgagagcaaaccctgtcctccagtggcgaaagctgggagactctgccggggaaagaagagcgggaacctccacaggctaaggtgagtgccagcactggcaccagccctggccccggtgctagtgccagtgccggggctggcgccggggccaatgctggcagcaatggcagcaattaccttgaagaagttcgagaaccatctcttcaggaagagcaggcatccctggaagaaggagaaattccttggctccagtaccatgagaatgacagtagcagtgagggggataatgattctggtcacgagttgatgcaacctggggtattcatgctggatggaaacaacaaccttgaagatgactccagtgtgagcgaagacctagaagtggattggagcctctttgatggatttgcagatgggttaggagtggctgaagccatttcctatgtggaccctcagttcctcacctacatggcacttgaagaacgcctggcccaggcaatggaaactgcccttgcgcacttggagtctctcgcagtggatgtagaggtggccaatccaccagcaagcaaggagagcattgacgctcttcccgagatcctggtcactgaagatcatggcgcagttggtcaggagatgtgctgccccatctgctgtagcgaatatgtgaagggggaggtggcaactgagctgccgtgccaccactatttccacaagccgtgtgtgtccatctggcttcagaagtcaggcacctgccccgtgtgccgctgcatgttccctcccccactctaaagaccaaggccgtttactcctggtctgattattttccccatctgaaatccacaatactgcaggagccctcttgaaattaacaatggaaataaaaccaatcagtcagttagcctaaacctattgattcctcgtgattatttccaatgtgaaaacagttgtgtatgattgcattaaaaatcatatcatcttttagaggttagaaaagggaaaactaaactttctaaatgctacttgagattgcagtaagaagatacgttttctaacctgaaagttaaatcgcatttgttttcttcagtagaatgggaatgtgttgctgttacttgtaatgtcaagtttatctgttaaatatgtccaaaaggcaaaatcatttttgttgcatgttatgggtcgatgttcctgtaattgcagtgccgtaaaagcttattaaagttgttcttttggttttaaaaaaaaaaaa

SEQ ID NO: 98 - DNA, 8538 bp, Homo sapiens
  CDS (127)..(7020)
ttacaccaactgcagtgtgaatggaagacccggaacctgtcatcccagctgcagactggaagagacctggaagatgaagtcgttgtcagctactctcatcctcacgtcaggctgcttcgccaaaggatggatcggctggataatttaacctgtcacctgttgaagaaacaggcctttagaccccagctgcctgcctacgagtccctggttcaggagatccaccactacgtcaccagcatcgccaaggcccctgctgttcaggatctgctcacacggcttctgcaggccctccacatagatgggccacggtctgcccaagtagcccagagccttctaaaggaggaggcctcttggcagcagtcacaccaccagttccggaagcggctgtcagaggagtacaccttctatccagatgccgtgagcccactgcaggcatccatattgcagttacaacatggcatgaggctggtggcctctgagctccacacctcactccacagcagtatggttggtgcagacaggctggggaccctggccacagccttgctggctttcccatcggtgggccccaccttcccgacttactatgctcatgcagacactttgtgctcggtgaagtctgaggaggttctacgaggccttgggaagctaatcctcaagcgctcaggaggaaaggagctggaaggcaagggccagaaagcctgtcccactcgggagcagctgctgatgaatgctctcctttacctgcgctcccacgtgttatgcaagggagagttggaccagagggccctgcagctcttcagacatgtgtgtcaggaaatcatcagtgagtgggatgagcaggaacgcatagcccaagagaaggctgagcaggaaagcggcctgtatagatacaggagcaggaactctaggacagccctgagtgaagaggaggaggaagaacgggagttcagaaaacagttccccctgcatgaaaaggactttgcagatattttggtgcagccaacgttggaggagaacaaaggaacttcagatgggcaagaagaggaagcaggcacaaacccagctctcctctcccagaattcaatgcaggcagtaatgctgatacaccagcaattgtgtctcaactttgctcgatccctctggtatcaacagactctgccgccacatgaagcaaagcattacctcagcctgtttctgtcttgctatcagactggggcatcgcttgtgacacacttctaccccctgatgggagttgaactgaatgaccgactcttgggcagccaacttttggcctgtaccctctcccataacactctttttggggaggcaccctcagacctgatggtgaaacctgatgggccctatgacttctaccagcatcccaatgttccagaagcacggcagtgtcaacctgtgcttcaaggtttctcagaggctgtcagtcacttgctacaggactggccagaacacccagcgcttgaacagctcctggttgtaatggacagaattcgtagtttcccactttccagtcccatctcaaagttcctgaatggcttagagatccttctggcaaaggcacaggattgggaggaaaatgcaagtcgagctttgtctttgcggaaacatcttgatttgatcagtcagatgatcattcggtggcgtaaactggagctgaactgctggtccatgagtttggataatactatgaagcgccacaccgagaaatccaccaagcactggttctccatctatcagatgcttgagaagcacatgcaggaacaaacagaagaacaggaagatgacaaacagatgaccttgatgttgctggtcagcacattacaagcatttattgaaggatcctcgctgggagagttccatgtgcgacttcagatgttactggttttccattgtcatgtcttgctgatgccacaggttgaaggaaaggattcactttgcagtgttctatggaatttgtaccattattacaagcaattctttgaccgggtccaggccaaaattgtggaacttcgttcccccctagaaaaagaacttaaagaatttgttaagatttccaagtggaatgatgtcagcttctggtccattaagcaatctgtagaaaagacacacaggacactctttaaattcatgaagaaatttgaagcagtcctgagtgaaccctgccggtcatccctggtggagagtgacaaggaagaacagcctgactttttgcccaggccaacagatggagctgcaagtgaactgtcttccattcagaatctgaacagggcactgagggagaccctgttagcccaaccagcagctgggcaggccacaattccagagtggtgtcagggcgctgctccttccggcttggaaggggagcttctgcgtcgcttgccaaagctcaggaaacgcatgaggaagatgtgcctgacgttcatgaaggagagccccctgcctcgccttgtggagggccttgatcagttcacaggtgaagtgatttcctctgtgagtgagctgcagagcttaaaggtggaaccctctgcagagaaggagaagcagcggtcagaagccaagcacattctcatgcaaaaacagcgagctttgtcagacctctttaaacaccttgcaaaaattggtttgtcgtatcgcaaaggtcttgcttgggcccgttcaaaaaaccctcaagagatgcttcatcttcacccattagatctccagagcgcattgtccatcgtcagcagcactcaggaggctgattctaggctgcttacagaaatctcgtcttcatgggatggatgccagaagtatttttatcgctctcttgcacggcatgccaggcttaacgcagcactagcaactcctgccaaggaaatgggcatgggcaacgtggagaggtgcagagggttctcagcacatttgatgaagatgctcgtccgacagcggcgctccctgaccacgctcagtgagcagtggatcatcctcaggaacctcctcagctgtgtgcaagagattcacagcaggctgatggggccccaggcctaccccgtggccttcccccctcaggatggcgtgcagcagtggacagagcgcctgcagcacctggccatgcagtgccagatcctgcttgagcagctctcctggctcctccagtgctgccccagtgtagggccagctccaggccatggcaatgtccaggtactggggcagcctcctggcccctgcctggaaggaccagaacttagcaagggacaactttgtggagtagtgctggacctaattccttccaatctgagctacccatctccaatacctggaagtcagctgccctctggttgccggatgcggaaacaggatcacctttggcaacagtcaactacgagattaacagagatgctaaaaaccattaaaacagtgaaagctgacgtcgacaaaattagacagcagtcttgtgagactctctttcattcttggaaagattttgaagtttgctcttctgcgctgagttgcttgtcccaggtgtcagttcatttgcagggcctagagtccttgttcattcttccagggatggaggttgagcaaagagactcacaaatggcactagttgaaagtctggaatatgtaagaggagaaattagtaaagccatggctgactttactacctggaagacccatctgcttacttcagatagccaaggaggaaatcaaatgttggacgaaggatttgtggaagatttttcagagcaaatggaaattgccatccgagccatcctctgtgccatccagaacttagaagaaagaaagaatgaaaaagcagaggagaacactgaccaagcaagcccacaagaagattatgcaggctttgagagactgcaatcaggacatctaacaaaactcttagaggatgacttctgggccgatgtgagcactttgcacgtgcagaaaataatttctgccatctccgagctgttggagaggctgaaatcgtacggtgaggatggcacagcagcaaagcacctgttcttcagccaatcctgttccttgctggtgcgcctggtgccggtcctctccagctactcagacctcgtcctcttcttcctgaccatgtctttagcaactcaccgtagtactgcaaagctgctctctgtgcttgcccaggtctttacagagcttgcccagaagggattttgcttgcccaaagaatttatggaagattcagctggagagggagcaactgagttccatgactatgagggaggtggaattggagaaggcgagggcatgaaggatgtgagtgaccagatcggaaatgaagaacaggtggaagatacatttcagaagggtcaagaaaaagacaaagaggatcctgattcaaaatctgatattaagggcgaggataatgccattgagatgtcggaagattttgatgggaaaatgcatgatggggagcttgaagaacaagaagaggatgatgagaaatcagatagtgagggcggagacctggataaacacatgggcgatctcaatggtgaggaagctgacaaactagatgagaggctttggggtgatgatgatgaggaggaagatgaggaggaagaagacaataaaactgaagaaacaggaccaggaatggatgaggaagattctgaacttgttgctaaagatgacaacttggatagtggcaattcaaacaaagataaaagccagcaagataagaaggaagaaaaggaagaagcagaagctgatgatggtggacaaggtgaagacaaaattaatgaacaaatagatgagagggactatgatgaaaatgaggtggacccttaccatggcaatcaggaaaaggtgccagaacccgaggctttggaccttccagatgacttgaacctcgacagtgaagacaagaatggtggtgaggacaccgacaatgaagaaggagaagaagagaatcctttggagataaaagaaaaaccagaagaagcaggtcatgaagctgaggaaagaggagagaccgagaccgaccagaacgaaagtcagagtccacaggagcctgaggaaggccccagtgaagatgacaaggcagaaggggaagaggaaatggacacaggagctgatgaccaagatggagatgctgctcagcatcctgaagaacactctgaggagcagcagcagtctgtggaggaaaaagacaaggaagccgatgaagaaggtggagagaatggccctgctgaccaaggtttccagccccaggaggaagaagaacgggaggactctgatacagaggagcaggtgccagaggctttggagaggaaggagcatgcctcctgtgggcagactggtgtggagaacatgcagaacacacaggccatggagctggctggggccgcacctgagaaggagcaggggaaagaggaacacggaagtggagctgcagatgcaaaccaggcagaaggccatgaatcgaatttcattgcccagttggcctcccagaagcacaccaggaaaaacacacagagttttaagaggaaacctgggcaggctgacaatgaacgttccatgggtgatcacaatgagcgtgtgcacaagaggctgaggactgtggatacggacagccatgccgagcaggggccagctcagcagccccaggcccaggtggaggatgcagatgcattcgagcacattaaacaaggcagtgacgcatacgatgcacagacctatgatgtggccagcaaagaacagcaacagtctgcaaaagactctggcaaagatcaggaagaggaggagatagaggacacccttatggacacagaggagcaggaggagttcaaagcagcagacgtggagcagctgaagccagaggaaatcaagtcgggcaccacagcacccttgggctttgatgagatggaagtggagatccaaactgttaaaacagaggaagaccaagaccccagaacagacaaagcccataaggagacagaaaatgagaaaccagaaagaagccgagagtctaccattcatacagctcatcaattcctcatggacacgatcttccagccctttttaaaagatgtcaatgagctaagacaggagctggagagacagctggaaatgtggcagccacgtgaatctggaaacccagaggaggagaaggttgcagctgagatgtggcagagttacctgatcttaacagcgcctctttcacaacggttatgtgaagagcttcgtctcatattagagcctacccaggcagccaagctgaaaggagactatcgaactgggaaacgactaaacatacggaaagtcattccatacattgctagtcaatttcggaaagacaagatttggcttcgaaggaccaagcccagtaaacgccagtatcagatttgtttggctatcgatgactcttctagtatggtagacaatcataccaagcagcttgcatttgaatctttggctgtgattggaaatgctctaaccctcctggaagtgggtcagattgcagtgtgtagttttggagaatctgtaaagctgttacacccatttcatgagcagttcagtgattactctgggtcccagattctacgtctctgcaaattccaacaaaagaaaaccaagattgctcagtttctagagtctgttgccaacatgtttgcagctgctcagcagctctcgcagaacatcagttcagaaactgcacaactcctcctggtagtctctgatgggcgaggccttttccttgagggcaaagaaagagtcctggcagcagttcaggctgcccggaatgcaaatatctttgtcatctttgttgtattggacaatcccagttcacgggattctatcttggacattaaagtaccgatatttaaaggacctggagagatgcctgaaatccgatcctacatggaagagttcccattcccatactatatcattcttcgagatgtaaacgcacttcctgagacactcagcgatgccctcagacagtggtttgagttggtgacagcctctgaccacccatagaacagaaagaagagtccaaagtgagacttaactgtggtcagaaggtcacattgcttacccaggtgctcccttttggacaactacaaaaaattttattgtaatatttttattttacaacgtgatcttacagcctacagaatgctctctggctcccggctttgcctgggctgaggtttttataccaaacctggaagcagcagcaggtgcctgaactcgtaactagagaagagttatccttcttccctgccttggaagccctggcctgggaggaggtcataccccaccgttggagcccagctgcctgttttcttttgcaggggatctgggcacctgtgccttgaggagatgctgccaggagcatgggactctgacagtcctttgtataaaggactaaagggagctgcccttttgaccctgttctaagctctgccttgccaagcccatagtgtgtgcccaaaagctgtcaagtggccaagacagctcgtttctggagagtatgagggtgtgttttcttattgtgaaaggaactaccttctcttagagggtaggaagaatgtggtgtgtgtgtgttctcataaagcaactggacattataggtgcccaggtcatctataaaaacgatccttgggctgtgtaaaaatgaagtggcttttcagtatcctctttcacacttgctgcttcgggagactatgcaatgatgggaaggtgattgcccctttatttcattcagtgccatggtccctgttgttgtagtaatttatttgtttagttcatttttttttttcttaacagtcaaggggaagagtgattcctcacactgctttcaagctggactgagccagtctcattctgggaaagaaacgctgtgtccagaactcagcagctccatctattttttccagtcgaaagaaactgatctttaggcagtttttacttggccagaaagcagtgctgaatacttgaaactgtgtgctctgttctacttaatgttctgtcagaatgttcttttgtaggcagtatgtcatgatgtaatcatctatctccttgtctgtttccaagttacactgtgaagtctgcgacccttttgaggtggtcatcaaagacacagattccttgtttaaccaagtgtcccaaagcatgtacctgaagttatatcattttttattctaaaaagctatgcagcttatattctgaaaactattaaaacatataccactgttgttgatgtaatttgtgactcttcttaatggaagatgacaggattgtaaaaggtatgctaggggactgatcttctctgctggatcagtcagtcagctgttactagttgatgctgtgctaacatgatcccctcctacttccatgttgctcttactacaaaggttatcatttgcatttatgtccatggtaggctgagctataatatgctggctttgcagcagaatgaaaaggatgagttggtgtagccttataaggaggcttataaaaataaattatcctccataaatgaaaaaaaaaaaa

SEQ ID NO: 99 - DNA, 2163 bp, Homo sapiens
  CDS (152)..(1441)
ctagagggttcttcttccttctacttctgctgaagggtaacttccgatatcaacttcctcaaacctctgatgagctgctgctgctcgactctgaggtgcattctttttttgatgagaggcatctctaggtaccatccctgacctggtcctcatgctgccgaggctgttgctgttgatctgtgctccactctgtgaacctgccgagctgtttttgatagccagcccctcccatcccacagaggggagcccagtgaccctgacgtgtaagatgccctttctacagagttcagatgcccagttccagttctgctttttcagagacacccgggccttgggcccaggctggagcagctcccccaagctccagatcgctgccatgtggaaagaagacacagggtcatactggtgcgaggcacagacaatggcgtccaaagtcttgaggagcaggagatcccagataaatgtgcacagggtccctgtcgctgatgtgagcttggagactcagcccccaggaggacaggtgatggagggagacaggctggtcctcatctgctcagttgctatgggcacaggagacatcaccttcctttggtacaaaggggctgtaggtttaaaccttcagtcaaagacccagcgttcactgacagcagagtatgagattccttcagtgagggagagtgatgctgagcaatattactgtgtagctgaaaatggctatggtcccagccccagtgggctggtgagcatcactgtcagaatcccggtgtctcgcccaatcctcatgctcagggctcccagggcccaggctgcagtggaggatgtgctggagcttcactgtgaggccctgagaggctctcctccaatcctgtactggttttatcacgaggatatcaccctggggagcaggtcggccccctctggaggaggagcctccttcaacctttccctgactgaagaacattctggaaactactcctgtgaggccaacaatggcctgggggcccagcgcagtgaggcggtgacactcaacttcacagtgcctactggggccagaagcaatcatcttacctcaggagtcattgaggggctgctcagcacccttggtccagccaccgtggccttattattttgctacggcctcaaaagaaaaataggaagacgttcagccagggatccactcaggagccttcccagccctctaccccaagagttcacctacctcaactcacctaccccagggcagctacagcctatatatgaaaatgtgaatgttgtaagtggggatgaggtttattcactggcgtactataaccagccggagcaggaatcagtagcagcagaaaccctggggacacatatggaggacaaggtttccttagacatctattccaggctgaggaaagcaaacattacagatgtggactatgaagatgctatgtaaggttatggaagattctgctctttgaaaaccatccatgaccccaagcctcaggcctgatatgttcttcagagatcctggggcattagctttccagtatacctcttctggatgccattctccatggcactattccttcatctactgtgaagtgaagttggcgcagccctgaagaaactacctaggagaactaatagacacaggagtgacagggactttgttatcagaaccagattcctgccggctcctttgaaaacaggtcatattgtgctcttctgtttacaagaggaaacaagatggaataaaagaaattgggatcttgggttggagggacagtgaagcttagagcacatgaactcaaggttagtgactctgcaggacttcacagagagagctgtgcccatcattcagtccaagtgctttctctgcccagacagcacagaactccagccccgctacttacatggatcatcgagtttccacctaaaatatgattctatttattttgagtcactgttaccaaattagaactaaaacaaagttacataaaaagttattgtgactccacttaattttagtgacgtatttttgtatatataggccaacctataccacatccaaaattatgtatctattacagcccctagaagctttataaatacagtgtgtcttcttttattcacaaaatttttgaaatcgtggtaatatggtttgaaacctgtatc

SEQ ID NO: 100 - DNA, 2142 bp, Homo sapiens
  CDS (152)..(1420)
ctagagggttcttcttccttctacttctgctgaagggtaacttccgatatcaacttcctcaaacctctgatgagctgctgctgctcgactctgaggtgcattctttttttgatgagaggcatctctaggtaccatccctgacctggtcctcatgctgccgaggctgttgctgttgatctgtgagctgtttttgatagccagcccctcccatcccacagaggggagcccagtgaccctgacgtgtaagatgccctttctacagagttcagatgcccagttccagttctgctttttcagagacacccgggccttgggcccaggctggagcagctcccccaagctccagatcgctgccatgtggaaagaagacacagggtcatactggtgcgaggcacagacaatggcgtccaaagtcttgaggagcaggagatcccagataaatgtgcacagggtccctgtcgctgatgtgagcttggagactcagcccccaggaggacaggtgatggagggagacaggctggtcctcatctgctcagttgctatgggcacaggagacatcaccttcctttggtacaaaggggctgtaggtttaaaccttcagtcaaagacccagcgttcactgacagcagagtatgagattccttcagtgagggagagtgatgctgagcaatattactgtgtagctgaaaatggctatggtcccagccccagtgggctggtgagcatcactgtcagaatcccggtgtctcgcccaatcctcatgctcagggctcccagggcccaggctgcagtggaggatgtgctggagcttcactgtgaggccctgagaggctctcctccaatcctgtactggttttatcacgaggatatcaccctggggagcaggtcggccccctctggaggaggagcctccttcaacctttccctgactgaagaacattctggaaactactcctgtgaggccaacaatggcctgggggcccagcgcagtgaggcggtgacactcaacttcacagtgcctactggggccagaagcaatcatcttacctcaggagtcattgaggggctgctcagcacccttggtccagccaccgtggccttattattttgctacggcctcaaaagaaaaataggaagacgttcagccagggatccactcaggagccttcccagccctctaccccaagagttcacctacctcaactcacctaccccagggcagctacagcctatatatgaaaatgtgaatgttgtaagtggggatgaggtttattcactggcgtactataaccagccggagcaggaatcagtagcagcagaaaccctggggacacatatggaggacaaggtttccttagacatctattccaggctgaggaaagcaaacattacagatgtggactatgaagatgctatgtaaggttatggaagattctgctctttgaaaaccatccatgaccccaagcctcaggcctgatatgttcttcagagatcctggggcattagctttccagtatacctcttctggatgccattctccatggcactattccttcatctactgtgaagtgaagttggcgcagccctgaagaaactacctaggagaactaatagacacaggagtgacagggactttgttatcagaaccagattcctgccggctcctttgaaaacaggtcatattgtgctcttctgtttacaagaggaaacaagatggaataaaagaaattgggatcttgggttggagggacagtgaagcttagagcacatgaactcaaggttagtgactctgcaggacttcacagagagagctgtgcccatcattcagtccaagtgctttctctgcccagacagcacagaactccagccccgctacttacatggatcatcgagtttccacctaaaatatgattctatttattttgagtcactgttaccaaattagaactaaaacaaagttacataaaaagttattgtgactccacttaattttagtgacgtatttttgtatatataggccaacctataccacatccaaaattatgtatctattacagcccctagaagctttataaatacagtgtgtcttcttttattcacaaaatttttgaaatcgtggtaatatggtttgaaacctgtatc

SEQ ID NO: 101 - DNA, 4479 bp, Homo sapiens
  CDS (456)..(4448)
acggttcaaataatgttgtccacctttcccagaaactggatattgggctattccctggccaattgctccctgatatcaggaaggagccagggtggagctccagcagcaaactgacccaggctgttagagtccgagttgcaaatttcaagagcgacaatctgactgggccagtctggcctctgggtcagttccccggggtcaggtctctgcaggatgatgttcaaccatcgcagccaaggagcaacagagccacgagaacatcactctggcttctccctgggcagcagaaggaaggtggagaagacacctccaaaaggcatctgtcacaggttgaggccaacatccccatcagctctgaggccgaacagtgcctccctacatctacctgccaagggcactggcagggcttaagttatgcagccctgatagccgactggccggtggtggtcttgggcatgtgcaccatgttcatcgtagtctgtgccttggttggagtattagtgccagagctccctgacttctctgatccattgctgggttttgaaccaagaggaacagcaataggccagagattggtcacatggaataatatggtgaaaaatacaggatacaaagcaacattagcaaattatccctttaaatatgcagatgaacaagccaaaagccatcgggatgatagatggtcagatgatcattatgaaagagagaaaagagaagttgactggaacttccacaaggacagctttttctgcgacgttccaagtgaccgatattccagagtggtatttacttcatctggaggggagacattatggaatttacctgcaattaaatcaatgtgcaatgtagataattccaggatcagatctcatccccagtttggtgatctctgccagaggaccactgctgcctcctgctgccccagctggacactgggaaactacatcgccattctgaacaatagatcgtcctgtcagaaaatagttgagcgagacgtttctcataccttgaagctgcttcggacttgtgccaaacactaccaaaatggcactctggggccagactgctgggacatggcagccagaagaaaggaccagctcaagtgcaccaatgtgccacgcaaatgtaccaagtacaatgctgtgtaccagatcctccattacttggtggacaaagactttatgaccccaaagacggctgactatgccacgccagctttaaaatacagcatgctcttctctcccacagagaaaggggagagcatgatgaacatttacttggacaactttgaaaactggaactcttctgacggcgtgactaccatcaccgggattgagtttggtatcaaacacagtttgtttcaggattatcttctaatggatactgtgtatcctgccatagccattgtgattgtccttttagttatgtgtgtctacaccaagtccatgtttatcactctgatgacaatgtttgcaataatcagttctttgattgtttcctattttctctatcgtgtagtatttcacttcgaattttttccttttatgaacctcactgccctcattattttggttggaattggagcagatgatgcttttgtcctgtgtgatgtttggaactacacaaaatttgataagcctcatgccgaaacctcagaaacagtaagcatcaccttgcagcacgctgccctctccatgttcgtcaccagttttaccactgctgctgccttttatgctaactatgttagcaacattacagcaatccgatgctttggggtttatgcggggacagctatattggtgaattacgttttgatggtcacatggcttccagcagttgttgtgctgcatgagcggtatcttcttaatatattcacttgcttcaaaaagccccagcagcaaatatatgataacaaaagctgctggacagtggcttgccagaagtgccacaaagtactctttgccatttcagaagcatctcgaatttttttcgaaaaagtattgccatgcattgtcattaagtttcgctacctttggctgttttggttccttgccttaactgtaggtggggcctacattgtatgtataaatccaaagatgaaactgccctcactggagttatccgagttccaggtgttccggtcgtcccatccttttgagcgttatgatgctgaatacaaaaagcttttcatgtttgaacgtgttcaccatggcgaggagctccacatgcccatcacagtaatctggggcgtgtccccagaagacaatggcaacccactaaatcccaagagtaaagggaagttgacattagatagcagttttaacatcgccagcccagcttcccaggcctggattttgcacttctgtcaaaaactgagaaaccaaacattcttttaccagactgatgaacaggacttcaccagctgcttcattgagacattcaaacagtggatggaaaaccaggactgtgatgagcctgccctgtacccatgctgcagccactggagcttcccctacaagcaagagatttttgaactgtgcatcaagagagctatcatggagctggaaaggagtacagggtaccatttggatagcaaaaccccagggccgaggtttgatatcaatgatactatcagggcagtggtgttagagttccagagtacctacctcttcacactggcttatgaaaagatgcatcagttttataaagaggtggactcgtggatatccagtgagctgagttcggcccctgaaggcctcagcaatggttggtttgtcagcaatctggagttctatgacctccaggatagcctctccgatggcaccctcattgccatggggctgtcagttgctgttgcatttagcgtgatgctgctgacaacttggaacatcatcataagcctttatgccatcatttcaattgctggaacgatatttgtcactgttggttctcttgtcctgctgggctgggagctcaatgtgttggaatctgtcaccatttcggttgccgtcggcttgtctgtagactttgccgtccattatggggttgcctaccgcttggctccagatcccgaccgagaaggcaaagtgatcttctctctgagtcgcgtgggctctgcgatggccatggctgccctgaccaccttcgtggcaggggccatgatgatgccctccacagttctagcttacacccagctgggcaccttcatgatgctcatcatgtgtatcagttgggctttcgccaccttctttttccagtgcatgtgccggtgccttggaccacagggtacctgtggtcagattcctttacctaaaaaactacagtgcagtgccttttcccatgccttgtctacaagtcccagtgacaagggacaaagcaaaacacataccataaatgcttatcatttagatcccaggggcccaaaatctgaactggagcatgagttttatgaattagaacctctggcttcccacagctgcactgcccctgagaagaccacttatgaagagacccacatctgctctgaatttttcaacagccaagcaaagaatttagggatgcctgtgcatgcagcttacaacagtgaactcagcaaaagcactgaaagtgacgctggctctgccttgttacagccccctcttgaacagcataccgtgtgtcacttcttctctctgaatcagagatgtagctgcccagatgcctacaaacacttgaactatggcccacactcttgccagcagatgggggactgcttgtgccaccagtgctctcctaccactagcagctttgtccagatccaaaacggcgtggcacctctgaaggccacacaccaagctgtcgagggctttgtgcaccccatcacgcacatccaccactgtccctgcctgcagggcagagtaaagccagccggaatgcagaattctctgcctaggaattttttcctccacccagtgcagcacattcaggcccaagaaaaaattggcaagaccaatgtacacagtcttcagaggagcatagaagagcatcttccaaagatggcagagccatcgtcatttgtctgcagaagcactggatcgttactcaaaacgtgttgcgaccccgagaataaacaaagggaactctgtaaaaatagagacgtgagcaatctggagagcagtggagggactgaaaacaaggcaggagggaaagtggagctgagcttgtcacagacggatgcaagtgtgaactcagaacatttcaatcagaatgaaccaaaagtcctatttaatcatttaatgggggaggctggttgtaggtcttgcccaaataattcacaaagttgtggcagaattgtgagagtgaagtgcaattctgtggactgtcaaatgccaaacatggaagccaatgtgcctgctgtattaacacactcggaactttctggtgaaagtttgttaataaaaacactataataaatgcagcattcaattcaaaaaaaaaaaa

SEQ ID NO: 102 - DNA, 1893 bp, Homo sapiens
  CDS (367)..(1623)
cttccctccccaggccacggcagcccggccctcccgggcagacctcccgcaccagggctctggtgaacagcaaatgctccacgctgggacgggccattgcctgatgcctgtacatggtgggcactgagagacaagattcctgggccctgccttccatacactccccacgatctcggaggaagctctggggaccccgctgagaacccacagacaggaggacaactgcgctatgacagcaataaaggccaagaaggagaaagttgaggaccgctgacagccccgtgtgctgttgggagctgccctttctacttcaaaccttcctctagcagactgtgcagggaccccccaccaccaccatctgccgccatggttgtgcaaaacagcgcagatgccggggacatgagggcaggcgtgcagctggagcccttcctgcaccaggtcggggggcacatgagcgtgatgaagtatgacgagcatacggtgtgcaagcccctcgtctcccgggagcagaggttctatgaatccctgccgctggccatgaagcggttcaccccacagtacaaaggtaccgtcacagtgcacctctggaaagacagcacaggccatctcagcttggttgccaacccagtgaaggagagccaggagcccttcaaggtctccacagagtcggcggcggtggccatatggcagacgctccagcagaccaccggcagcaatggcagcgactgcacccttgcccagtggccgcatgcccagctggcacgctcacccaaggagagcccggccaaggctcttctgaggtccgagccccacctcaacactccagccttctcgctggtggaagacaccaacggaaaccaggttgagaggaagagcttcaacccgtggggcctgcaatgccaccaggcccacctgacccgcctgtgctccgagtacccagagaacaagcggcatcgtatccttgccatccccctcacatggttcttgttgctggaaaatgtagtgtcacagtacacgcatccctgtgtcctggatctgaagatggggacccggcagcacggcgatgatgcatcggaggagaagaaggcccgccacatgaggaagtgtgcgcagagcacctcagcctgcctgggtgtgcgcatctgcggcatgcaggtttatcaaacagataagaagtactttctctgcaaagacaagtactatggaagaaaactctcagtggaggggttcagacaagccctctatcagttcctacataatggaagccacctccggagggagctcctggagcccatcctgcaccagctccgggccctcctctctgtcattaggagccagagttcataccgcttctattccagctctctccttgtcatctatgatgggcaggaaccaccagaaagagccccaggcagcccgcatcctcacgaggctccccaggcagcccacggtagctctcccggtggtctcaccaaggttgacatccgcatgattgactttgctcataccacatacaagggctactggaatgagcacaccacctacgatggaccagaccctggctatatttttggcctggaaaacctcatcaggatcctgcaggatatccaagagggagaatgaaacttcctgggcttatctggattcttctgggctatagatctcaaatagagacctgttggttgctagggtagtccagacaccccttagatgtcttcataatagtcctatctaccttcaaaaaccatctctatatatggcagactatattaacagctgctgaacaaatcagctctggaggtgattccacatcccctggcattatgctctaatgctgctcatcggagaacagacagccaggataaagtggcaccttctggagtacactgggag

SEQ ID NO: 103 - DNA, 1863 bp, Homo sapiens
  CDS (367)..(1593)
cttccctccccaggccacggcagcccggccctcccgggcagacctcccgcaccagggctctggtgaacagcaaatgctccacgctgggacgggccattgcctgatgcctgtacatggtgggcactgagagacaagattcctgggccctgccttccatacactccccacgatctcggaggaagctctggggaccccgctgagaacccacagacaggaggacaactgcgctatgacagcaataaaggccaagaaggagaaagttgaggaccgctgacagccccgtgtgctgttgggagctgccctttctacttcaaaccttcctctagcagactgtgcagggaccccccaccaccaccatctgccgccatggttgtgcaaaacagcgcagatgccggggacatgagggcaggcgtgcagctggagcccttcctgcaccaggtcggggggcacatgagcgtgatgaagtatgacgagcatacggtgtgcaagcccctcgtctcccgggagcagaggttctatgaatccctgccgctggccatgaagcggttcaccccacagtacaaaggtaccgtcacagtgcacctctggaaagacagcacaggccatctcagcttggttgccaacccagtgaaggagagccaggagcccttcaaggtctccacagagtcggcggcggtggccatatggcagacgctccagcagaccaccggcagcaatggcagcgactgcacccttgcccagtggccgcatgcccagctggcacgctcacccaaggagagcccggccaaggctcttctgaggtccgagccccacctcaacactccagccttctcgctggtggaagacaccaacggaaaccaggttgagaggaagagcttcaacccgtggggcctgcaatgccaccaggcccacctgacccgcctgtgctccgagtacccagagaacaagcggttcttgttgctggaaaatgtagtgtcacagtacacgcatccctgtgtcctggatctgaagatggggacccggcagcacggcgatgatgcatcggaggagaagaaggcccgccacatgaggaagtgtgcgcagagcacctcagcctgcctgggtgtgcgcatctgcggcatgcaggtttatcaaacagataagaagtactttctctgcaaagacaagtactatggaagaaaactctcagtggaggggttcagacaagccctctatcagttcctacataatggaagccacctccggagggagctcctggagcccatcctgcaccagctccgggccctcctctctgtcattaggagccagagttcataccgcttctattccagctctctccttgtcatctatgatgggcaggaaccaccagaaagagccccaggcagcccgcatcctcacgaggctccccaggcagcccacggtagctctcccggtggtctcaccaaggttgacatccgcatgattgactttgctcataccacatacaagggctactggaatgagcacaccacctacgatggaccagaccctggctatatttttggcctggaaaacctcatcaggatcctgcaggatatccaagagggagaatgaaacttcctgggcttatctggattcttctgggctatagatctcaaatagagacctgttggttgctagggtagtccagacaccccttagatgtcttcataatagtcctatctaccttcaaaaaccatctctatatatggcagactatattaacagctgctgaacaaatcagctctggaggtgattccacatcccctggcattatgctctaatgctgctcatcggagaacagacagccaggataaagtggcaccttctggagtacactgggag

SEQ ID NO: 104 - DNA, 3252 bp, Homo sapiens
  CDS (491)..(2506)
ccgactctggtgatgtacgaagggagaggcactgctgggcctgccatacagctgcacagcataagggaccgccctggcatggccacagccttggtgacctccttctccacatccagccaggggagagtctcagagagccccagcctgctctccgtgctgctgccagaattgttttcctacaacactctcaggaccagggaaacacagaaagctgttttaggggagcatctggcttctgctcctccaactcattctctgcagagcagcaagagtgaagtacctgcgtgtggagaaggaaccgcccgccccctccccggctctggacccggttctgtgggagggtccgttccgggctcggtgcgactgcgcagctcctcggcgcttcctcggtggcttccccgggtcgagcaaacaggtaaggtcggggagacttcaggccagggcagtctcctgtcttctcttggaaaccacagcagcccatgcacacagaatggcagccacattccagcttccagggcaccaggagatgccgctgaccttccaggatgtggccgtgtacttctctcaggcggaggggcggcagctgggcccccagcagcgggcgctctaccgggatgtgatgctggagaactatgggaacgtggcctctctgggattccctgtccctaagccggagttgatctcccagctggagcaggggaaggaactttgggtcctgaatcttctgggagctgaggaaccagatatcttgaaaagctgccagaaagattctgaggttgggaccaagaaggaactatctattttaaaccaaaaattttccgaagaagtaaaaaccccagaatttgtatcaagaagactcttaagggataatgcacaggccgctgagtttcgggaagcatggggccgtgagggcaaactcaaagagcgcgtgggaaattctgccgggcagagtttgaacaaacccaatattcacaagagagttttaacagaagctaccgtgggcagggaaagatctttgggagaaagaacccaagagtgtagtgcatttgatagaaacttgaatctggaccaaaatgttgttagacttcaaagaaataaaacaggagagagggtctttaaatgtgatatatgcagcaaaaccttcaaatataattcagacctaagtagacaccagagaagtcacactggggagaagccgtacgaatgtggccggtgtgggcgagcctttactcacagctcaaatcttgttctgcaccatcacattcacactggaaataaaccatttaaatgtgatgaatgtgggaaaacttttggactcaattctcacctccgtcttcatcggagaattcacactggagaaaaaccctttggctgtggtgagtgtgggaaggctttcagtcgaagctcaactcttattcaacatcggatcattcacacaggagagaaaccctacaagtgtaatgaatgtggaagaggctttagccagagcccccagttaactcagcatcagagaattcacactggagagaagccgcatgaatgcagtcactgtgggaaggccttcagtcgaagctccagccttattcagcatgagagaattcacactggagagaagccccataaatgcaatcagtgtgggaaggccttcagtcagagctcaagccttttcctccatcatcgggttcatactggagagaaaccctatgtatgtaatgaatgcggcagagcctttggttttaactctcatcttactgaacacgtaaggattcacacaggagaaaaaccctatgtttgtaatgagtgcggcaaagcctttcgtcggagttccactcttgttcagcatcgaagagttcacactggggagaagccctaccagtgcgttgaatgtgggaaagctttcagccagagctcccagctcaccctacatcagcgagttcacactggagagaagccctatgactgtggtgactgtgggaaggccttcagccggaggtcaaccctcattcagcatcagaaagttcacagcggagagactcgtaagtgcagaaaacatggtccagcctttgttcatggctccagcctcacagcagatggacagattcccactggagagaagcacggcagagcctttaaccatggtgcaaatctcattctgcgctggacagttcacactggtgagaaatcctttggatgtaatgaatatggaaaagctttcagtcccacctcacgacccactgaagatcagataatgcatgctggggaaaagccctataaatgtcaagaatgtggaaacgccttcagtggaaagtcaacccttattcaacatcaggtaactcacactggtcagaaaccatgtcattgcagtgtgtatgggaaagccttcagccagagttcacagctcacaccacctcagcagactcgtgttggagagaaacctgctttaaatgatggctctaaaagatactttattcatatcaagaagattttccaagaaagacatttttaatgtgataaatgcagaagacagtttagcaactgttcacttgacattagaagataagatggcataatgaaagatatataaggtctaaatattactggcaaagtaaaataaatagttcagatgactactaaagtcaaagtcattaaatctggaagtaaacacgagaattcattctgggaaatcaggctgtctgtgtaaaggttactgctgtgctcaggagttgaaccgtgtggtgctgtatccggatactcatgacgaatggatggagggcgtgaaaagtgagcccagctggtgctctgggtctaccctacctgacatccttccagtcttatcctttgtttcctatccaggcccaggcttgtggctgagaacatccactttcagtcccatatacctgcctccaagtgtggtacagagaacttgggcctgctgggggcgcttagccttactctctccaccacctctcccaccaacccccagatgaactgcaggtagacgtttcttccttgcttggagccccagtttttgcatttcattttcattaaaatgaaaggtggtttggttttggttctaaggagctctacagtttaacagagagagggaccttaggggccaagaaagcaggggcctaccaagtatctccacttttgaaaattgtaattactgataaaaaattttttaaaggcaggtttattgaagcataatttataaacaataaaatttactctttttagtgtaaaaaaaaaaaa

SEQ ID NO: 105 - DNA, 2785 bp, Homo sapiens
  CDS (309)..(1826)
gcacgaggttcatgtctgccatctggctccaggattgggattatccccgggactctgaccgcgagttctaccggcatctcctggcgcacgggtataggacgcggaggatgctgagctgctgtcgcactgcagcacatctacagatgtacggatgccctcctcttgatcttacagggtccgaggtacagccgccagaaaggtctagtcaggaacagacagagtcgcttgaggactcatgagggggggtgctgcgctgacaacagactacaccctcacagtttgctctgctcttcccacaccagtggaagatgatcacatcccagggatcagtgtcgtttagggatgtgactgtgggcttcactcaagaggagtggcagcatctggaccctgctcagaggaccctgtacagggatgtgatgctggagaactacagccaccttgtctcagtagggtattgcattcctaaaccagaagtgattctcaagttggagaaaggcgaggagccatggatattagaggaaaaatttccaagccagagtcatctggaattaattaataccagtagaaactattcaataatgaagttcaatgagtttaacaaaggtggaaaatgtttctgtgatgaaaagcatgaaataattcattctgaagaggaaccttctgaatataataaaaatgggaacagcttctggctgaatgaagacctcatttggcatcagaaaattaaaaattgggaacaatcttttgaatacaatgaatgtgggaaagctttccctgagaattcactcttccttgtacataagagaggttacacaggacagaaaacctgcaaatatactgaacatgggaaaacctgtgatatgtcatttttcatcactcatcagcaaacacatccaagagaaaaccactatggtaatgaatgtggagaaaatatctttgaggaatccattctccttgaacatcagagtgtttacccattcagccagaagttaaatctcactccaattcagagaacccactcaattaacaatattattgaatataatgagtgtggaacatttttcagtgaaaaattagtccttcatttacaacagagaacacatacaggagaaaaaccttatggatgtcatgaatgtgggaaatccttcagtgaaaagtcaacccttactcaacatcaaagaacgcacacaggggagaaaccatatgaatgtcatgaatgtgggaaaaccttctcatttaagtcagtccttactgtgcatcagaaaacacacacaggggagaagccctatgaatgctatgcatgtgggaaagcctttctcagaaaatcagacctcattaaacatcaaagaatacacacaggtgaaaaaccttatgaatgtaatgaatgtgggaagtcattctctgagaagtcaacccttactaaacatctaagaactcacacaggtgagaaaccttatgaatgtattcagtgtggaaaatttttctgctactactccggtttcacagaacatctgagaagacacacaggggagaaaccttttggatgtaatgaatgtgggaaaaccttccgtcagaagtcagccctaattgttcaccagagaactcatataagacagaaaccctatggatgtaatcaatgtggaaaatcattctgtgtgaagtcaaaactcattgcacatcatagaacacacacaggggagaaaccctatgaatgtaatgtttgtggaaaatcattctatgttaagtcaaaactaactgtacatcagagaatacacttggggagaaaccctataaatgtagtaaacgagggaaattactctgggtgaagtcagaactttgtagaacacagaacataaagggtgagagaaatctgttaatataatgataatgagaacacctttgccctgaagtcagttctcacagtatagaagagaacttaaagagggaaaaaacaatatgaagatagggaatgcaggaaaacattattctggaatttggaccatacactatgttacaaaactaaaagtggaaaaaacttattggtgaatgaatataggaaacattttgcccaatgccactcttcattaaacatcagagaattcacacggggtgaaacctgggtcagcatccctaggttgagaagggatgcatttttctgctactactacagtttcacagaatacctgagaagacacacttggagaaaccttttgggtgtaatgaatgtgggaaaacctttcatcagaagtcagctctaattgttcaccacagaactcatataagacagaaaccctatgggtgtaatgaatgtggaaaatcattctgtgtgaagtcaagaggccagagaaaatgcacaaactgtaggaaactataggaaagcatttactatgaggttatattttatggagtatatgtaataagaagtagcttctcagtgaacatcagatagtagagaaagtatttttaactgtatccaatgtgtggatgttttaagttaaaatctaaatttaatatagaacagaggtgttgagttgcaggatatctagcaatttaagaaaatgtggaaaaaatatttttattgagaaatagcattttactttgttaatatctagtttagttcattgtcaagactgctattttctaagagacttctaaagacgccactcaagccaatggctataagtagttcaaaggtttattgcttagccatatgaaaaataagggaagattttttagcaaggggacccacaaacaagagtgctcttgtatgtccaaaaaaaaaaaa

SEQ ID NO: 106 - DNA, 2440 bp, Homo sapiens
  CDS (629)..(2143)
gcgattccgggcaggcagtgagtgatccgggagttagggtcaggctgggggatgagaaactacggcgactgtatctttggccgaggagttttaaatgcgctggaagtgaagggactgtgtcgtcaagggtagagacgggaaaaaacgagaagtcctgaggaacatagattcccctcccccgtacattttcccggatggaagcccgaagtttgagggagaaacttgtgaggaaataaaggaagttgggctgaggggcagagagcgagacttttctattttccaaaagctcggtctgaggcccctcagtcttgcttcctaccccgcgcttgagtttctccccgcttggatgctctcaggggcagtgtgaagagagacagttcctggcttccttagagggccttgttctccttggcagaagctcaagtcctgattcccgcccttccttctcgttttaggaatattgttctgagaagccacagaaaaagggtatgggcttattttgccaaagaaaacacagcagttgcaccctgttttgcaaaaaccatcagtgtttgggaatgattctgatgatgatgatgagacctctgtgagtgaaagccttcagagggaagctgctaagaagcaggccatgaaacagaccaaactggaaatccagaaggcccttgcagaagatgctactgtgtatgaatatgacagtatttatgatgaaatgcagaaaaaaaaggaggaaaataatcccaaattgcttttggggaaagacagaaagcccaagtatattcacaacttgctaaaagcagttgagatcagaaaaaaggaacaggaaaaaagaatggaaaagaaaatacagagagaacgagaaatggaaaagggggagtttgatgataaagaagcatttgtgacatctgcatataagaaaaaactgcaagagagagctgaagaagaagaaagagaaaagagggctgctgcactggaagcatgtttggatgtaaccaagcagaaagatctcagtggattttataggcacctattaaatcaagcagttggtgaagaggaagtacctaaatgcagctttcgtgaagccagatctggtataaaggaagaaaaatcaaggggcttctccaatgaagtaagttcaaaaaacagaataccacaagagaaatgcattcttcaaactgatgtgaaagtagaggaaaacccagatgcagacagtgacttcgatgctaagagcagtgcggatgatgaaatagaagaaactagagtgaactgcagaagggaaaaggtcatagagacccctgagaatgacttcaagcaccacaggagtcaaaaccactctcggtcacctagtgaagaaagagggcacagtaccaggcaccacacgaaaggatcacgaacgtcgagaggacatgagaaaagggaagatcagcaccagcagaagcaatccagagaccaagagaaccattacactgaccgtgattaccggaaagaaagggattctcataggcacagagaggccagtcatagagattcccattggaagaggcatgaacaggaagataaaccaagggcgagggaccaaagagaaagaagtgacagagtatggaaaagggagaaagatagggagaaatattcccaaagagaacaagaaagagatagacaacaaaatgatcagaaccgacccagtgagaaaggagagaaggaagagaaaagcaaagcaaaggaagagcatatgaaagtaaggaaggaaagatatgaaaataatgataaatacagagatagagaaaaacgagaggtaggtgttcagtcttcagaaagaaatcaagacagaaaggaaagcagcccaaattctagggcaaaggataaatttcttgaccaagaaagatccaacaaaatgagaaacatggcaaaggacaaagaaagaaaccaagagaaaccctctaattctgaatcatcactgggagcaaaacacagactcacagaggaagggcaagagaagggtaaagaacaagagagaccacctgaggcagtgagcaagtttgcaaagcggaacaatgaagaaactgtaatgtcagctagagacaggtacttggccaggcagatggcgcgggttaatgcaaagacctatattgagaaagaagatgattgatggctaccccaagagaaagatttaaggaagcacagaaaactgtaattcctggaacctgctgcgtaaaaccataaaggagtgtgttaccagtagtttggagggcatttttaaatttattttcaaaattttaagttaaaagtcagtcttacagcttggatgtttggatgtggatgtttggctgaatttatatatagtgtgtactcatcaataccacattctttgttgtattcaagaaccgttaagagtgtgctaattccctgtaggtacataatgaggaaaatttgctccactacaacc

SEQ ID NO: 107 - DNA, 2072 bp, Homo sapiens
  CDS (99)..(1775)
gttcataaagcttatgacatgtcctgatttggtagcttcatgtggaagaggtagtagatgtatttgctgacatttaaacataaaggtttaagagcaagatggcgattccgggcaggcagtatgggcttattttgccaaagaaaacacagcagttgcaccctgttttgcaaaaaccatcagtgtttgggaatgattctgatgatgatgatgagacctctgtgagtgaaagccttcagagggaagctgctaagaagcaggccatgaaacagaccaaactggaaatccagaaggcccttgcagaagatgctactgtgtatgaatatgacagtatttatgatgaaatgcagaaaaaaaaggaggaaaataatcccaaattgcttttggggaaagacagaaagcccaagtatattcacaacttgctaaaagcagttgagatcagaaaaaaggaacaggaaaaaagaatggaaaagaaaatacagagagaacgagaaatggaaaagggggagtttgatgataaagaagcatttgtgacatctgcatataagaaaaaactgcaagagagagctgaagaagaagaaagagaaaagagggctgctgcactggaagcatgtttggatgtaaccaagcagaaagatctcagtggattttataggcacctattaaatcaagcagttggtgaagaggaagtacctaaatgcagctttcgtgaagccagatctggtataaaggaagaaaaatcaaggggcttctccaatgaagtaagttcaaaaaacagaataccacaagagaaatgcattcttcaaactgatgtgaaagtagaggaaaacccagatgcagacagtgacttcgatgctaagagcagtgcggatgatgaaatagaagaaactagagtgaactgcagaagggaaaaggtcatagagacccctgagaatgacttcaagcaccacaggagtcaaaaccactctcggtcacctagtgaagaaagagggcacagtaccaggcaccacacgaaaggatcacgaacgtcgagaggacatgagaaaagggaagatcagcaccagcagaagcaatccagagaccaagagaaccattacactgaccgtgattaccggaaagaaagggattctcataggcacagagaggccagtcatagagattcccattggaagaggcatgaacaggaagataaaccaagggcgagggaccaaagagaaagaagtgacagagtatggaaaagggagaaagatagggagaaatattcccaaagagaacaagaaagagatagacaacaaaatgatcagaaccgacccagtgagaaaggagagaaggaagagaaaagcaaagcaaaggaagagcatatgaaagtaaggaaggaaagatatgaaaataatgataaatacagagatagagaaaaacgagaggtaggtgttcagtcttcagaaagaaatcaagacagaaaggaaagcagcccaaattctagggcaaaggataaatttcttgaccaagaaagatccaacaaaatgagaaacatggcaaaggacaaagaaagaaaccaagagaaaccctctaattctgaatcatcactgggagcaaaacacagactcacagaggaagggcaagagaagggtaaagaacaagagagaccacctgaggcagtgagcaagtttgcaaagcggaacaatgaagaaactgtaatgtcagctagagacaggtacttggccaggcagatggcgcgggttaatgcaaagacctatattgagaaagaagatgattgatggctaccccaagagaaagatttaaggaagcacagaaaactgtaattcctggaacctgctgcgtaaaaccataaaggagtgtgttaccagtagtttggagggcatttttaaatttattttcaaaattttaagttaaaagtcagtcttacagcttggatgtttggatgtggatgtttggctgaatttatatatagtgtgtactcatcaataccacattctttgttgtattcaagaaccgttaagagtgtgctaattccctgtaggtacataatgaggaaaatttgctccactacaacc

SEQ ID NO: 108 - DNA, 1679 bp, Homo sapiens
  CDS (403)..(1548)
aagcggctgtgcgcatgagcagatgaggcctagccgaggcggcgggacccccaagattggaaagctcttttaacggctatgcgaaagctctgtccaaaggctgctcacagcccctgtctgactggatgtcatgatgaattgagctctctgttacctgcgcatcacaaccgagctgaggcttcgaagacctcagaggacttctctcagcactcacagaaacctcctacaccctcggatggcacaaagggactgttttcttactcttagtctgagtgactgccaaggaaggcaaaggtagagcaactggatctctggctctccacatagcttctgatctcagaccttactaaaatgctttctgggcccaaggacaaagctcacatgaacaaatgattttgagtcatgaatgaaaaatcttgctctttccatagtaaagaagaattaagagatggacagggtgaaagattgtctgctggatattctccatcatatgacaaggacaagagtgttctggctttcagaggaatccctatctcagagttgaagaaccatggcattctccaggctctgaccacagaagcttatgaatgggagccacgtgttgtgagtacagaggtggtcagagcccaagaagaatgggaagctgtggacaccatccagccagagacagggagccaagctagctcagagcagcctgggcagctaatctccttcagtgaggccctgcagcacttccagactgtggacctttcccccttcaagaaaagaatccagccaactattcgaaggactgggctcgccgccctccgacactacctcttcgggcctccaaagctccaccagcgccttcgggaagaaagggacttggtcctgaccattgctcagtgtggcctggatagccaagacccagtgcatggccgagtcctccagaccatctataagaagctgaccggctccaagtttgactgtgcccttcatggaaaccactgggaggacctgggctttcagggagcgaatccagccacagacctgagaggcgcaggcttccttgccctcctgcatctgctctacctggtgatggactcaaagaccttgccgatggcgcaggagattttccgcctgtctcgtcaccacatccagcaattccctttctgtttgatgtccgtgaacatcacccacattgccatccaggccttgagagaggagtgtctctccagagagtgtaatcggcagcagaaggtcatccccgtggtgaacagcttctatgccgccacattcctccacctcgcacatgtctggaggacacagcggaagaccatctcagactcgggctttgtcctcaaagagttggaagtattggccaagaagagcccacggcggctgctcaagaccctggagctgtacttggccagggtgtcaaagggacaggcctccttgttgggagcacagaagtgctatgggccagaagcccctcccttcaaggatctcaccttcacaggtgagagtgacctgcagtctcactcatccgaaggcgtatggctgatctgacctccgagatgaatggaggcttaaaggctgagctgcaggggctttcagggggtcagtggagccatgtcaggagcctggccaggccgcaccccttgctgtctcagcagatgggatataggaagctcctggcg

SEQ ID NO: 109 - DNA, 6013 bp, Homo sapiens
  CDS (411)..(5348)
cgggccaggaccccattacaggctctgtcctctcccctcgccccctcccccggcaaccgctctccctcgccccctcccctcagcgggtcctcctctttctctccctctccctctccctcctcctccctctccccatcccttcccccccacaatgcagttcgcggcgcggcggacatggcggtggagtcctgagctagtcgtgtcccggcctccagcggcggcagcggcgacggcggcggcagcaggaggcggagggagagcaggagccactgagatgaggaggcgtcgcgcgcgcctgtagctcgcgggcctcgcagtttgcttgcctaaactggacttgaagcaatttaaactactggagatctgccattttataatatcacaattggaaagaaacagattttcaaataatggaagagtctaaaaccttaaaaagtgaaaatcatgaaccaaagaagaatgttatttgtgaagaaagcaaagcagttcaagttataggtaatcaaacattgaaagctagaaatgataaatccgtaaaagaaattgagaacagctctccaaataggaatagtagtaaaaaaaataagcaaaatgatatttgtatagaaaaaacagaagttaaatcatgtaaagtaaatgctgccaaccttccaggtcctaaagatttggggttagtccttcgagatcaaagtcattgcaaagcaaaaaaatttcctaattcaccggtgaaagccgaaaaggcaaccatttcacaggcaaaatcagaaaaggcaaccagtttacaggcaaaagcagaaaaatcaccaaagtcacctaattcagtgaaagcagaaaaagcatccagttatcagatgaagtcagaaaaagtaccaagttcaccagcagaagcagaaaagggacccagtttactgttgaaagacatgagacagaagacagaattacaacagattggaaaaaaaattccaagctcctttacttctgtggacaaagtgaatattgaagctgtagggggagaaaaatgtgctctgcaaaactcaccacgatctcagaagcaacagacatgtacagataatactggtgattctgatgatagtgcttcaggaattgaagacgtatcggacgatttaagtaaaatgaagaatgatgaatctaataaagaaaattcttcagagatggactacttagaaaatgccactgtgatagatgaatctgcattgacacctgagcagaggctggggttgaaacaagcagaagaacgcttagaaagagatcacatctttcgacttgaaaaacgatcaccagaatataccaattgtcggtatctatgcaaactttgcttaattcacattgaaaatatccagggggctcataaacatataaaggagaaacgacataagaaaaatattttggaaaaacaagaagaaagtgagcttcgttctctgccacctccttcccctgcccacttggctgctttaagtgttgcagtcattgaattagcaaaagaacatggaataacagatgatgacctcagagtccgtcaggaaattgtggaggaaatgtcaaaggttataacgacatttttaccagaatgttcacttaggttgtatggctcatctctgactagatttgctctgaaaagtagtgatgttaatatagatataaaatttcctcccaagatgaatcatccagatcttctgataaaagtacttgggattttaaagaaaaatgtattatatgtagatgtggaatctgattttcacgctaaagttcctgttgtggtgtgcagagatcgaaaaagtggtttactttgtagagtgagtgcaggaaacgatatggcatgtctcactactgatttacttactgcccttggcaaaatagaacctgtctttattcccttggtgttagcctttcgctactgggctaagttgtgctatattgactcccaaactgatggtggaatcccttcttactgttttgctttaatggtgatgttttttctacaacagagaaaaccccctcttcttccttgcttacttggaagttggattgaaggctttgacccaaaaagaatggatgactttcagcagaagggcatagtagaagagaagtttgtgaagtgggaatgtaattcaagtagtgcaactgagaaaaactcaattgctgaggaaaacaaagctaaggcagaccaaccaaaagatgataccaagaagacagaaacagacaaccaaagtaatgccatgaaggaaaaacatggcaaatctcctttagcattggaaacaccaaatcgggtatccttgggacagttatggttagagctgcttaaattctacacactggattttgctttggaggaatatgtcatatgtgtacggatacaagatattttaacaagagaaaataaaaactggcctaaaaggcgaatagccattgaagatccattttcagtcaagaggaatgttgcacggagcttaaacagccagctggtttacgaatatgttgtggagagatttagggcagcttatcggtattttgcctgtcctcagacgaagggtggaaataagtctacagtggatttcaagaaaagagagaaggggaaaataagcaataagaaaccagtcaagtcgaacaatatggcaaccaatggttgtattctgcttggggaaaccacagaaaaaataaatgcagaaagagagcaacctgttcaatgtgatgaaatggactgtacatcacagagatgtattattgacaacaacaatttgttggtaaatgaactagattttgctgaccacggacaggactcttcatctctttctaccagcaaaagcagtgaaatagagccaaaattagataagaaacaagatgatttagcgccttcagaaacttgtttaaaaaaagagctcagccaatgtaattgcattgatttgtctaagtcgcctgacccagataaatctactggaacagactgcaggtcaaatttagaaacagagagttcacatcagagtgtgtgcaccgacacatctgctacctcttgcaactgcaaagctacagaagatgcttctgaccttaatgatgatgataacctccccacccaggaattatattatgtgtttgataagtttattttaacctctggcaagccaccaacgatagtatgcagcatctgcaaaaaggatggccattcaaagaatgattgcccagaggattttaggaaaattgatttaaaacctctaccaccaatgacaaaccgatttcgggaaatacttgatttagtatgtaaaagatgttttgatgagttatcaccaccttgttctgaacaacacaacagggagcaaattttaattggcttggaaaagtttattcaaaaagaatatgatgaaaaggcaaggttgtgcttatttggctcttctaagaatggatttggatttcgtgatagtgatctggatatttgtatgaccctggaaggccatgaaaatgcagagaaattaaattgtaaggaaataattgaaaatttggcaaaaattcttaagagacatccaggtttaagaaacattttgcctataactactgccaaagtgcctatagtaaaatttgaacacaggcgaagtgggttagaaggcgatatcagtttatataatacgttggctcaacataacacaagaatgctagctacttatgcagctattgatcctagagtgcagtatttgggatatactatgaaagtgtttgctaagcgatgtgacattggggatgcttccaggggaagtttatcttcatatgcatatatccttatggtgctgtactttctgcagcagagaaagccacctgttatcccagttctacaagagatctttgatggaaaacagattccacagagaatggttgatggatggaatgctttcttctttgataaaacagaagaactgaaaaagcgtttaccttcacttggaaagaacacagaatcattaggggagctttggctgggactgcttcgtttctatactgaagagtttgatttcaaggaatatgtaattagcattcggcagaaaaagctgttgacaacttttgagaagcagtggacttccaagtgcattgcaattgaagacccttttgacttgaatcataaccttggtgctggagtttccagaaaaatgaccaatttcatcatgaaagcatttatcaatggaaggaaactttttggtacccctttttatccactcattggcagagaagctgagtacttctttgattccagagtattaacagatggagaactggctcccaatgatagatgttgccgtgtgtgtggaaaaataggccactacatgaaagactgccctaaaaggaaaagcagtttactgtttagactaaagaagaaagacagtgaagaagagaaggaagggaatgaagaagagaaagattcccgagatgttcttgacccccgagacctccacgatactcgagactttagagacccgagagacctcagatgttttatatgtggagatgctggacatgtacgaagggagtgcccagaggtcaagctggcccgtcagaggaatagcagtgtggcagcagcccagctggtccgcaaccttgtaaatgctcaacaggtggctggttcagctcagcaacagggtgatcagtccataaggactagacagtcatcagaatgttctgaatcaccatcttattctcctcagcctcagccatttccacagaactcttcccagtcagctgctattactcagccttcatctcagccaggatcccaacctaagcttggcccacctcagcagggagcccaacctccccatcaggtccagatgccactgtataactttccccagtcaccaccagctcagtattctcccatgcacaatatgggattgttgccaatgcaccctctccagatccctgccccgtcctggcccatccatggcccagtgatccactctgcaccaggcagtgcccccagcaatattggcctaaatgatcccagcatcatctttgcacagcctgctgccagacctgtggcaatccctaacacgtctcacgatggacactggccccgtactgtggctccaaattccctggtaaacagtggtgcagtggggaattcagagccaggctttcgaggactgactcctccaattccttgggaacatgcaccgcgtccccatttcccccttgtcccagcttcgtggccttatggtttgcatcaaaacttcatgcatcagggaaatgcccgattccagcccaacaaacctttctatactcaagacagatgtgccacccgtcggtgtagagagcgttgtccccacccaccaagaggaaacgtgtcggagtaatgcgagtccattttctttcagctggtctaccgatgcacagcaaccagccaatcctgctgtctcaagggtatccgtacctcaatgtcagttacattcagcagaaaaagtgacatttaatggaaagcaaaacaaatcaggtcctgatttaaaattttaacacgtttagatagcttatttaaattctaagactgtttttacagactgtattatttgtatataaatatgaactatagtttttactagtatcaccaaattgagtgatacaaatttcatctattttattaccctatttttaagggaattttatgttttgtttaaccttgatgaattgtataaagagagaatttaaaaaattacattctttattttctattagctgtattcatactttggttgcttcagactttatatattgttcttaaaagttaggaaagaatttcatgtgttttaaattgtcacttctattctttacagaaccttgtagtgccaaaaactttttaaaaggtaaaaaaataaaataaaattacaacatgaagattcagattttttttcttttccatacttgtatattgaacattcaaacttgaatggaaagttgattttgtctgtatttgaagtacttctattttaagttaataaatctttttgacaagaaaaaaaaaaaa

SEQ ID NO: 110 - DNA, 2301 bp, Homo sapiens
  CDS (155)..(1837)
caagacgtccggcctcgggggcccgggctgggccgcgagtcccctgggcggcgctgagcgggcgggaggcgggggcccgcggctcggggcaaccgaggccgggtcgcgggatcggccgccatcgccgccgccgctgcactgggagcccgcgggtatggagcgggaggcgttgccgtggggcctcgagccccaggatgtgcagagttctgacgaaatgaggagccccgaagggtacctcagaggcaacatgagtgagaatgaggaagaggaaatttctcagcaagaaggcagtggggactatgaagtcgaagagataccatttgggcttgaaccccagagccctgggtttgagccacaaagcccagagtttgaaccccaaagccccagatttgagcctgaaagcccggggtttgagtcccgaagccctgggcttgtgcccccaagccctgagtttgcacccagaagccctgaatcagattctcagagccctgagtttgaatcccagagccctaggtatgaaccccaaagccctggctatgaacctcggagccccgggtatgaaccccggagccctggctatgaatctgagagctctagatatgaatcccagaacactgagctcaaaacccaaagcccagaatttgaagctcaaagttccaaattccaggaaggtgcggagatgcttctgaaccccgaggaaaagagtcctttgaatatctccgtaggagttcaccccctggactccttcactcaggggtttggggagcagcccacaggggacctgcccatagggccaccttttgagatgcccacaggggccctgctgtctacaccgcagtttgagatgcttcagaatcccctgggtctcacaggagcccttcgaggtccaggtcggcggggtggccgggccaggggtgggcagggccctcggcctaacatctgtggcatctgcgggaagagcttcgggcggggctccaccctgatccagcaccagcgcatccacaccggtgagaagccctacaaatgtgaggtctgcagcaaggccttctcccagagctctgacctcatcaaacaccagcgcacccacactggcgagcggccctacaaatgtccccgttgcggcaaggccttcgccgacagctcttacctgcttcgccaccagcgcactcactctggccagaagccctacaagtgcccacattgtggcaaggccttcggcgacagctcctacctcctgcgacaccagcgcacccacagccacgagcggccctacagctgcaccgagtgcggcaagtgctatagccagaactcgtccctgcgcagccatcagagggtgcacacccggtcagaggcccttcagctgtggcatctgcgggcaagagcttctcccagcggtcggcccttatcccccatgcccgcagccacgcccgggagaagcccttcaagtgccctgagtgcggcaagcgctttggccagagctcggtgctggccatccacgcccgcacccacctgccaggccgcacctacagctgccccgactgcggcaagaccttcaatcgctcctccactctcatccagcaccagcgctcccacacgggcgagcggccctacaggtgcgccgtgtgcggcaagggcttctgccgctcctccacgcttctgcagcatcaccgggtccacagtggcgagcggccttacaagtgcgatgactgcggaaaggccttctcccagagctccgacctcatccgccaccagcggacccacgcggcgggccggcgctgacctggggccccagcaggggtgggaggtgtgggcagaagataaggggccagggagctagaggaacctttagggaggatagtggagaagccgcaggagaatggaggagctgaggatgctggaagaagagaaccagggtggaggaagtgacatgccctggagacttgtgggaagtgggttggagggaggccaggccggcagcgggaggccctgggagaaatggagagaggtcagcggagggctggcctcagccgcggctccttggtgggtgcctggcttggcaactgctagagcagggaggggggagggcaggggattacctaattagagtgggttagcttagattggtagctgctgaaactctcgttgagtcaggagcgggtaaaaggtaggtggggtggggagtggggccccggggtggggcctgggcctctgcgtgcaaaccccagcctccctcttcttcctcaggctttggagcccctgagtttgagttcaataaaaactttatgtggtaaaaaaaaaaaa

SEQ ID NO: 111 - DNA, 5394 bp, Homo sapiens
  CDS (351)..(3614)
atgcatgagaagcagtagatgtgtctctcattctttcttctttcattgcctgctaagtactgttgtataccagtagcatgggtcagagtgggaggttgtcaacagaagagtccagcatgtatccatgatggactctcgatcaactttatatgattaactcatataaaacagccctgtatggaagctgaggctgcctcttcctagccacaggatattgacctactttccccttcttatctgcttgcaaaatattggtgtacttagtgtgttctccctgtcacaacgaatgttgtctctctctttcatatgaactgaaggctaaagtgctagttaaatcagtggacaaagcaatggagaagacaaagttgctggagaccatggccaaaatggaggtgaaaacctcacttctggacaatatgattggagttggggatatggttcttttagaacctctcaatgaggagaccttcatcaacaacctcaagaagcgctttgaccacagtgaaatatacacatacattggaagtgtggttatatctgttaacccataccggtctttacccatttattcaccagagaaagtggaagaatacaggaacagaaatttttatgaactgagccctcacatctttgccctttcggatgaagcatacagatccctacgagatcaagataaggaccaatgtattctcattactggggaaagtggagcaggaaaaacagaggccagtaagcttgtcatgtcctatgtggcagctgtttgtggaaaaggagcagaagttaatcaagttaaagaacagcttttacagtccaacccggtcctggaagcttttggaaatgccaaaactgtaaggaatgacaactcctctagatttggcaaatatatggatattgaatttgactttaaaggcgatccactaggaggagtaataagtaactatcttttagagaaatctcgggttgttaaacagccaagaggtgaaagaaacttccatgtgttctatcagctgctctctggtgcctctgaagagctcctcaataaacttaagcttgagagggatttcagcaggtataactacctgagtctggattcggccaaagtgaatggagtggatgatgcagcaaattttagaaccgtgcggaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatgagttaaaagaaatttgtgaattgaccggcattgatcaatcagttctagaacgagcattcagtttccgaacagttgaggccaaacaggagaaagtttcaactacactgaatgtggctcaggcttattatgcccgtgatgctctggctaaaaacctctacagcaggttgttttcatggttggtaaatcgaatcaatgaaagcattaaggcacaaacaaaagtgagaaagaaggtcatgggtgttctggacatttatggctttgagattttcgaggacaacagctttgagcagttcattattaattattgtaacgaaaagctgcaacaaatcttcattgaacttactcttaaagaagagcaggaggagtatatacgggaggatatagaatggactcacattgactacttcaataatgctatcatttgtgacctaatagaaaataacacaaatggaatcctggccatgctggatgaagagtgcctcagacctggcacagtcactgatgagaccttcttagaaaagctgaaccaagtatgtgccacccaccagcattttgagagcaggatgagcaagtgctctcggttcctcaatgacacgtctctgcctcacagctgcttcaggatccagcattatgctggaaaggtgctgtaccaggtggaaggattcgttgacaaaaacaatgaccttctctatcgagacctgtcccaagccatgtggaaggccagccatgccctcatcaagtctttgttccccgaagggaatcccgccaagatcaacctgaaaaggcctcctacagcaggctcacagttcaaggcatccgtggccactctgatgaaaaacctacagaccaagaacccaaactatattaggtgtatcaaaccgaatgataaaaaagcagcacacatcttcaacgaggctctagtgtgtcatcagatcaggtacctggggcttttggagaacgtccgagtgcggagggcaggctacgccttcaggcaggcctatgaaccttgcctagaaagatacaaaatgctttgtaaacaaacatggcctcattggaaaggaccagccaggtctggtgtggaggtcctatttaatgaattagaaattcccgtggaagaatactcctttggtagatcaaagatattcatccgaaacccaagaacattattcaaattagaagacctgaggaagcaacgcctggaggacttggccactctcattcagaagatatatcgggggtggaaatgccgcacacacttcctgctaatgaaaaaaagccaaattgtgattgccgcctggtacaggagatatgcgcaacaaaagaggtaccagcagacaaagagttccgccttagtaattcagtcttatatccggggttggaaggctcgaaaaattctgcgggaactgaagcatcaaaagcgctgtaaggaagcagtcacgaccattgctgcatattggcatgggacccaggtacgtagagaatacaggaaattcttcagagccaatgctggaaagaaaatctatgagtttacgcttcagagaattgtgcaaaaatacttcttggaaatgaaaaataagatgccttccttatctccaatagacaagaattggccctcaagaccttacttattcttggattctactcacaaggagctaaaaaggattttccacttgtggaggtgtaaaaaatacagggaccaattcacagaccagcagaaacttatttatgaagagaaactagaagccagtgaactcttcaaagacaagaaggctttatacccatctagtgttgggcaaccattccaaggggcttacctggaaatcaacaagaaccccaagtataagaaactcaaagatgccattgaagaaaagatcatcattgctgaagtcgtgaacaaaattaaccgtgctaatgggaagagtacatctcggattttcctcttaacaaacaataatctccttcttgctgaccaaaagtctggacaaatcaagtcagaggttccattggtggatgtgaccaaggtatcaatgagctcacaaaatgatggcttcttcgccgtccacctcaaagagggctcagaagcagctagtaaaggagactttctcttcagcagtgatcacctgattgaaatggccaccaagctctatcgcacaactctcagccaaaccaaacagaagctcaatattgagatttccgatgagttcctggtacagttcagacaggacaaagtatgtgtgaagtttattcagggaaaccagaaaaatgggagtgtcccaacatgtaaacgaaaaaacaaccgtctccttgaagttgctgtcccttaactggcgcctcctctctactttcatggacttgttcctttgtaatagtgcaatttggttttgttttatttggggttcattgtatgtttgggaatcaccaaaggcttttagagttctttggcaaaataaaaatatttgactaatcaatttttattattggaatagttttaacctttcaaatacatgttctgtcctggagcaggattgtagaaactaacagtgtctattttcatgtctgatgtgttcttcctttagtcatcatgttaggtctgtgtaccctaaatcagcatattactcataaatcattaattaatataagcataggaaatggtcttaaaagatactgcattcattcatcagatatttattccatgcctactctatgctaggcactgtgctagatggtatgaaaacttattaggaacctttttgtttttgagaccattgcattctggctggtttgtgctggtttaacgacatctaagaaggtttagaaatggtgagaccaaaacaataactgttaatgatggacagcattattaggaaccctgtagtatgatatttaacaatataggcttcaagaagggctggtcctaagagggggcagaaatgaatgaccaggttaaatccctctacatgtggtttctgtttgaaaaaaagaaaactgacatttgaacaggacttttaatttgtttaaaactctggtaattacttgtaacagtagaaaatagaagtcattcttattttagaaaaagtgacagaagcagtccagtaagattatatgtttctgtttctggtaaataccatatatgatcctcgaaatgataatatctccagaatattgttttcacccaaatttgagtagatattttaaacacctaacaaagtaaagggctaaaagccattcagatagcagtaaaacattctgtatgatgtgcaataaaacatccaagatcttttttgaaagttttatttataatatacatttttgtatgagaaaggtgattggtacagggtgcctattttagtcatggatcaaaatttgtgtaacttgcagggctttctttctttttcttcaaatttacaagggttcattttggaaactacattttaaactttggaatcaaattgtttcttatttgggaggataatgtatatacattggtattatgttaaataataaaattgttctaatttggtgccatttcctgaatcacaactgtatttttgtatctcaagctattttcatatgttatgtgtcaatgtatcatctctcagaaaggttttacaatccaaacattatatgttctctgtgtaactgaatttcacttatcttttataaaccagaaacattaattgaaaatattttctggggattttctcttgacttgtatttttaaaaattgctcacataaagaagttctcagaagtctttgtgtttattggtgcaggtagaggatgtaattacttagattcttcttgccttgtgcctaaagtggtagattaatagttcctgatactggtgagtagaaatttgggaatgagagggtgtggtgttttaaataacatgcagtatgttcacattgttcagcatgtaagtaagtgttaaaatatatacattacaaattctccatcctatcaaccagctatctgcttagttcccaccctccccgaaacattaaccattgttgttagttgcttttgtattactttgtccatatgtttgcaaaaggaaatcaaaatagattcttacgtttttttgctttagtagaaaaaaaaaaaa

SEQ ID NO: 112 - DNA, 2899 bp, Homo sapiens
  CDS (119)..(2899)
gggaaggagcgaaggagcgaaggagcaagcggagcgcagttcgcccaagccaagccgcgctgccaaccctcccgcccgcccgcgctcctgtccgccgtgtctagcagcggggcccagcatggtcatggcggatggcccgaggcacttgcagcgcgggccggtccgggtggggttctacgacatcgagggcacgctgggcaagggcaacttcgctgtggtgaagctggggcggcaccggatcaccaagacggaggtggcaataaaaataatcgataagtctcagctggatgcagtgaaccttgagaaaatctaccgagaagtacaaataatgaaaatgttagaccaccctcacataatcaaactttatcaggtaatggagaccaaaagtatgttgtaccttgtgacagaatatgccaaaaatggagaaatttttgactatcttgctaatcatggccggttaaatgagtctgaagccaggcgaaaattctggcaaatcctgtctgctgttgattattgtcatggtcggaagattgtgcaccgtgacctcaaagctgaaaatctcctgctggataacaacatgaatatcaaaatagcagatttcggttttggaaatttctttaaaagtggtgaactgctggcaacatggtgtggcagccccccttatgcagccccagaagtctttgaagggcagcagtatgaaggaccacagctggacatctggagtatgggagttgttctttatgtccttgtctgtggagctctgccctttgatggaccgactcttccaattttgaggcagagggttctggaaggaagattccggattccgtatttcatgtcagaagattgcgagcaccttatccgaaggatgttggtcctagacccatccaaacggctaaccatagcccaaatcaaggagcataaatggatgctcatagaagttcctgtccagagacctgttctctatccacaagagcaagaaaatgagccatccatcggggagtttaatgagcaggttctgcgactgatgcacagccttggaatagatcagcagaaaaccattgagtctttgcagaacaagagctataaccactttgctgccatttatttcttgttggtggagcgcctgaaatcacatcggagcagtttcccagtggagcagagacttgatggccgccagcgtcggcctagcaccattgctgagcaaacagttgccaaggcacagactgtggggctcccagtgaccatgcattcaccgaacatgaggctgctgcgatctgccctcctcccccaggcatccaacgtggaggccttttcatttccagcatctggctgtcaggcggaagctgcattcatggaagaagagtgtgtggacactccaaaggtcaatggctgtctgcttgaccctgtgcctcctgtcctggtgcggaagggatgccagtcactgcccagcaacatgatggagacctccattgacgaagggctggagacagaaggagaggccgaggaagaccccgctcatgcctttgaggcatttcagtccacacgcagcgggcagagacggcacactctgtcagaagtgaccaatcaactggtcgtgatgcctggggcagggaaaattttctccatgaatgacagcccctcccttgacagtgtggactctgagtatgatatggggtctgttcagagggacctgaactttctggaagacaacccttcccttaaggacatcatgttagccaatcagccttcaccccgcatgacatctcccttcataagcctgagacctaccaacccagccatgcaggctctgagctcccagaaacgagaggtccacaacaggtctccagtgagcttcagagagggccgcagagcatcagatacctccctcacccagggaattgtagcatttagacaacatcttcagaatctggctagaaccaaaggaattctagagttgaacaaagtgcagttgttgtatgaacaaataggaccggaggcagaccctaacctggcgccggcggctcctcagctccaggaccttgctagcagctgccctcaggaagaagtttctcagcagcaggaaagcgtctccactctccctgccagcgtgcatccccagctgtccccacggcagagcctggagacccagtacctgcagcacagactccagaagcccagccttctgtcaaaggcccagaacacctgtcagctttattgcaaagaaccaccgcggagccttgagcagcagctgcaggaacataggctccagcagaagcgactctttcttcagaagcagtctcaactgcaggcctattttaatcagatgcagatagcagagagctcctacccacagccaagtcagcagctgccccttccccgccaggagactccaccgccttctcagcaggccccaccgttcagcctgacccagcccctgagccccgtcctggagccttcctccgagcagatgcaatacagccctttcctcagccagtaccaagagatgcagcttcagcccctgccctccacttccggtccccgggctgctcctcctctgcccacgcagctacagcagcagcagccgccaccgccaccaccccctccaccaccacgacagccaggagctgccccagcccccttacagttctcctatcagacttgtgagctgccaagcgctgcttcccctgcgccagactatcccactccctgtcagtatcctgtggatggagcccagcagagcgacctaacggggccagactgtcccagaagcccaggactgcaagaggccccctccagctacgacccactagccctctctgagctacctggactctttgattgtgaaatgctagacgctgtggatccacaacacaacgggtatgtcctggtgaattag

SEQ ID NO: 113 - DNA, 1994 bp, Homo sapiens
  CDS (136)..(1680)
agctgggacctcagcatcaacaacagcaacttgtgattggcggtgaccggatattcagttgcacatccccacatcaatgcactgccaatgggttatatcctgtgttgtgacctcatggtttaagtgggaataaagatgagtataagcagtgatgaggtcaacttcttggtatatagatacttgcaagagtcaggattttctcattcagcatttacctttggtatagaaagccatatcagtcagtccaatataaatggtgccctcgtcccacccgctgcattgatttctatcatccagaaaggtctacagtatgtagaagcagaagttagtattaatgaggatggtaccttgtttgatggtcgaccaatagagtctctgtccctgatagatgccgtaatgcctgatgtagtacaaacaagacaacaagcttatagagataagcttgcacagcaacaggcagcagctgctgcagctgccgcagctgcagccagccaacaaggatctgcaaaaaatggagaaaacacagcaaatggggaggagaatggagcacatactatagcaaataatcatactgatatgatggaagtggatggggatgttgaaatccctcctaataaagctgttgtgttgcggggccatgaatctgaagtttttatctgtgcctggaaccctgttagtgatctcctagcatcagggtctggagactcaacagcaagaatatggaatcttagtgagaacagcaccagtggctctacacagttagtacttagacattgtatacgagaaggagggcaagatgttccaagcaacaaggatgtcacatctctagattggaatagtgaaggtacacttctagcaactggttcctatgatgggtttgccagaatatggactaaagatggtaaccttgctagcaccttagggcagcataaaggccctatatttgcattaaaatggaataagaaaggaaatttcatcctaagtgctggagtagacaagactacaattatttgggacgcacatactggtgaagccaagcaacagtttccttttcattcagcaccagcattggatgttgattggcagagcaacaacacctttgcttcttgtagtacagatatgtgcattcatgtctgtaaattaggacaagacagacctattaaaacattccaaggacatacgaatgaagtaaatgctatcaaatgggacccaactggcaatctcttggcctcctgttctgacgacatgactttaaagatatggagtatgaaacaagacaattgtgtccatgatttgcaagcacataataaagaaatttatactatcaaatggagtccaacaggaccagggactaataatccaaatgccaaccttatgttagcaagtgcatcctttgattctactgttaggttatgggatgtagaccgagggatatgcatccataccttgacaaaacaccaagagcctgtgtacagtgtagctttcagtcctgatggcaggtatctggcaagtggttcttttgacaaatgtgtacacatctggaacacgcagacaggtgctctagttcacagctataggggaacaggtggaatatttgaagtttgctggaatgcagcaggagacaaagttggagccagtgcatcagatggttcagtttgtgtattagaccttcggaaatagcgctactagttggaagccatggaccgactatgaatgtgtacatagccaaaatgactgtccctgacccatgtactgctatagtcccacttgaaccatggccagtccactacagccaaatctaaaagaaatatatacatacagtgtatataaacaaaattgcaccctgaagatgacagagttttgtcacagcttgtgaattctgttcaccaagtgctggaatctaatctgctgtgcccctaaaatagcatttagaagttttggatatgaaaaacagaagagagaaaaatatacattataaaagcaaaaaaaaaaaa

SEQ ID NO: 114 - DNA, 6222 bp, Homo sapiens
  CDS (1)..(5988)
atgggtcttggcaaaactattcaatcaattacattcctctatgaaatccttctgactggtataagaggacctttcctgattattgctccactttctactattgcaaactgggagagagaatttcgtacgtggactgatattaacgttgtggtttatcatgggagcctgattagcagacaaatgatacagcaatacgagatgtacttcagggattcacaggggcgtatcattcgaggagcttacagattccaagccatcatcaccacttttgaaatgattcttggaggctgtggagagcttaatgcaattgaatggcgatgtgtgattattgatgaagcacataggttaaaaaataaaaattgtaaactcttagagggcctgaaactcatgaatctggaacacaaggtgcttttgactggcacccctctccaaaatacagttgaagaactatttagtcttcttcactttcttgaacccttaaggtttccttctgaatcaacatttatgcaagaatttggggatctgaaaacagaggaacaggtacagaaacttcaggttatcctgaaaccaatgatgttgagacgattaaaagaagatgtggaaaagaagttggcacctaaagaagaaaccatcattgaagtagaacttactaatattcaaaagaaatactaccgggctatcttggaaaagaacttttcttttttatccaaaggagcaggacaaactaatgtacctaacttggtcaataccatgatggagctcaggaaatgttgtaatcatccatatcttataaaaggtgctgaggagaaaatacttggagaatttagagatacttacaatccagctgcttctgattttcatcttcaagcaatgatccagtctgctggtaaattggtccttattgataaattgcttcccaaaatgaaagccggaggtcataaagtgctcatcttctctcaaatggttcgttgccttgacattctggaggactatctcatacataaaagatacttatatgagcgaattgatggcagagtcagaggaaatcttcggcaagctgctatagatagatttagtaaacctgattcagatagatttgtttttctcctgtgtacccgagctggtgggttgggcatcaacttaactgcagctgatacatgtataatttttgattctgattggaatcctcagaatgatcttcaggcccaagctcgttgccacagaattggtcagaacaaagcagttaaagtctacagactggtaactcgtaactcatatgagagagagatgtttgaccgagccagtttgaaactgggcctagataaagctgtgttacagagcatgagtggaagagaaagtaatgttggtggtattcagcagctttccaaaaaggaaatagaagatctgcttcgaagaggtgcttatggtgctattatggaggaagaagatgaaggctctaaattctgcgaagaggatatcgatcagattttactacgtcgtacaaaaactattacaattgaatcagaaggacgtgggtcaacatttgccaaggcgagttttgtggcatctggaaaccggacagatatttctttagatgatcccaacttctggcaaaaatgggctaaaaaggcagaaatagatatagaggccatcagtggcagaaacagcttggttattgacactccaagaattaggaagcaaacaagaccttttagtgccacaaaagatgaattggctgaattatctgaagctgaaagtgaaggagatgaaaagcccaaactccggagaccctgtgaccgttccaatggctatggaagaactgaatgctttagagttgagaaaaacctgctagtttatgggtggggccgatggagagagattctatctcatggccgtttcaaaaggcagctaaatgaacacgatgtagagataatttgccgagctctcttagcatattgccttgttcactaccgaggagatgagaagattaaaggtttcatatgggatctcattactccaactgaagatggacagacacgagagctacagaatcatctaggcctatcagctcctgtacccaggggtcgaaaagggaagaaagtaaaaactcaaacaagctcatttgatatacaaaaagcagaatggcttcgaaaatataatcccgagcagctccttcaagatgaaggctacaaaaaacaaaaaaaacaccactgtaataaggttttgcttcgtgtgagaatgctgtattatctaaagcaagaagttattggaaatgagtgtcagaaagtatttgatggagttgatgcaagtgacattgatgtttgggtaccagaaccagaccactcagaagttcctgctgagtggtgggattttgatgctgataagtcactccttattggagtttttaaacatggatatgaaaaatataacactattcgagcagacccagcattatgcttcttggaaagagtgggaaaacctgatgagaaagcagttgctgctgaacagagagcgaatgattatatggatggggatgtggaagatccagaatacaaacctgccccagccatctttaaagatgatatagaggatgatgtttcctcaccaggagatcttgttatagcagatggagatggtcaactgatggagggtgataaagtatattggcctactcaatcagctttaaccacacgtttgaggcgtctcatcactgcataccagcgtactaataaaaacagacaaattcagcagatacaaccgactttctcggtgcctaccagtgtaatgcagcctatttatgaggaagccactcttaatcctaaaatggcagccaagatagaaagacagcaaagatggacaagaagagaagaagctgacttttatagggttgtatctacatttggagtggtttttgaccctgacagaggccaatttgattggacaaaatttagagctatggctaggctacataagaaaactgatgatagtttggaaaaatatttgtacgcattcatgtccatgtgtcggagggtttgtcgtcttccttccaaagaagaattggtggatccaaatatttttatccagcccatcacagaagaacgtgcttctaggactttgtatcgcattgaacttctaaggaaagtacgggaacaggcccttcgacatccacagttgtttgaacgcttgaagctttgccatccaaatccagatttaccagtctggtgggaatgtggccctcatgatagggatttgcttattggtgctgccaaacacggggtgagccgaacagactatcacattcttcgtgatcctgaactctcatttatggcagctcagaggaactacagtcaaagtaagatggctcattcaaggacttctaccccacttctacagcaatatcaagtagcactttctgcttctcctcttacctctctacctaggctcctagatgctaaaggtattattctagaggagatgaaagttaaaagtgaaaaccttaaagaggagcctcagtcttctgaagaagaatctatgtcttctgtggaaaccaggacactgataaaatctgagcctgtaagtccaaagaatggtgttttaccacaggctactggagaccagaaatctggtggaaaatgtgaaacagacagacgcatggttgcagccagaacagaacccctaactccaaacccagcttctaagaaaccaagagtccacaaaaggggatcagaatctagttctgattctgactcagattctgagagatcatcttgttcttccagatcatcttcttcctcatcatcctcttcttgctcccactctcgatcaggctctagttcttcttcatcttcatcttgttcttcagcatcttcttcatcctcttcctccacctcttcctcctcctcctcctcttcatcttcatcagaagaaagtgacagtgatgaagaagaagcccaaaaacgagaaagtactactcacatgaaagcctatgatgaagaaagcgtcgcgtcactgagcactacccaggatgagactcaggatagttttcagatgaacaatgggacaccagagtctgcttatatcttacaaggtggatatatgctggcagcctcgtattggccaaaggatcgtgtgatgatcaataggttggacagtatttgtcaaacagttctgaaaggaaagtggccttcagctagaagaagttatgatgctaacacagtggcttctttctataccacaaaactgctggacagccctggagcagctacagaatacagcgagcccagtgtacccactcccccaggtgccggtgttaaagaagaacatgatcagtcaacacagatgtcaaaggaaggtggtttgaagttgacatttcagaagcaagggcttgctcagaaaagaccatttgatggtgaagacggtgctctggggcagcagcagtacctcactcggcttcgagagcttcaaagtgcatcagagaccagcctcgtcaatttcccaaaatccataccagtatcaggtacttccattcaaccaacccttggtgccaatggtgtgatattagacaaccagcctatagtcaaaaaaaggcgaggaaggaggaagaatgtagaaggtgttgacatcttcttttttaacagaaataaaccacctaatcatgtttctttaggcttaacctcctcacagatttccacagggataaatccagcactatcctatactcaacctcaaggaattcctgatacagaaagtccagttccagttattaatcttaaagatggaacgagacttgcaggagatgatgcaccaaagagaaaggatttggaaaaatggcttaaggagcacccgggttatgtggaagatttgggagcttttattcctagaatgcagcttcatgagggaagacccaaacaaaaaagacaccgttgcagaaaccccaataaactagatgtgaatagtctcactggagaagaacgtgttcaactgattaacagaagaaatgctagaaaggttggaggtgcatttgctccccctttgaaagatttatgtagattcctaaaagaaaattcagaatatggagtagctcctgaatggggagatgttgttaagcaatctggatttcttccagaaagcatgtatgaacgtattctcactggtcccgttgtgagagaggaagtaagcaggcgggggagacggcctaaaagtggaattgcaaaggccacagcagcagcagctgctgcatctgccaccagtgtttcaggcaatcctttgttagccaatggactacttccaggtgtggatctcacaactcttcaggccttacaacaaaacctacaaaacttgcagtcactgcaagtaactgctgggttgatgggaatgcctaccggccttccttctggaggagaagctaaaaacatggctgctatgttccccatgctgctgtcaggaatggctggattaccaaatctgttgggcatgggaggactcctgacaaagcctacggaatctgggacagaagacaaaaagggaagtgactctaaggagtcagaaggaaaaacagaaaggacagagagccaaagttcagagaatggtggagaaaactctgtgtcaagttctccttccgcatcctctactgctgcattaaatacagctgcagctgccaacccattagctcttaacccactattactatctaatatactttatccagggatgcttctcactccaggccttaatcttcatattccaactttgtcccagtccaatacttttgatgtacaaaacaaaaacagtgacttaggctcgtctaagtctgtagaagtaaaagaagaagattccagaattaaagatcaggaagacaaaggaggaactgaaccaagtcctctcaatgaaaacagcacagatgagggttcagagaaagctgatgcttcatctggatctgatagtacatcgtcgtcatctgaggattcagattctagtaatgaagactgattcccagactctgcacttaaaatatgaactgattttggattttttctttaataattaattgtaaataccccagtgttgagtgcatcaataacttactgaccgaacatttcagttatttgtttagaagtgcaaactgctttcagagactttttgcatgtaatatttcttaagattcataagtttctgaactcgtatgtactatcaaatacataaaggtgtaaaattaaaaaaaaa

SEQ ID NO: 115 - DNA, 1673 bp, Homo sapiens
  CDS (14)..(1342)
ggcccggcccacgatgacttgctaccgaggcttcttgctgggcagctgttgtcgcgtggcgggcggccgggcggcggcgctgcggggaccgggtgcgggaggccccgccgcgcggccccggctgggcggtgacggtggcggccggcggcacctggggcaggggcagccgcgcgagctggcgggctgtggcagccgcgcggacggcggcttccgcccctcccgggtggtggtggtggccaaaaccacccggtacgagttcgagcagcagcggtaccgttacgcggagctctcggaggaggacctgaagcagctgcttgcattgaaaggctctagttacagtggacttcttgaacgacatcatattcacaccaaaaatgtagaacatattatagatagtttacggaatgagggaattgaggttcgtctagtaaagaggagagaatatgatgaagagactgttcgatgggcagatgctgtcatagctgcaggaggtgatggcacaatgctgctggcagcgagtaaagtcttggacagacttaaaccagttataggggtaaacactgatccagaacggtctgagggtcatttatgcctgcccgttcgatatacacattcctttccagaagccttacagaagttctatcgtggtgagttcaggtggttgtggaggcagagaatcaggttataccttgaagggactggcataaaccctgtacctgtggaccttcacgagcagcagctaagcttgaatcagcacaatagagcccttaacattgaaagagctcatgatgaaaggtctgaggcttcaggaccccaacttctgccagtgagagcactaaatgaagtcttcattggggagagtctgtcatccagggcttcctactatgagatttcagttgatgatggtccatgggaaaaacagaagagttcagggctcaatttgtgtactggaacaggatcaaaggcctggtcattcaatattaacagggttgcaactcaggctgtagaagatgttttaaatattgcaaaacgacaaggaaatttgagtcttccattgaacagagaattggtagagaaagtaacaaatgaatataatgaatcactgctctacagtccggaagaaccaaaaatacttttcagtattcgagaaccaatagcaaatagagttttctcaagcagtcgtcagcgttgtttctcctcaaaggtttgtgttcgttctcgttgttgggatgcctgtatggttgtggatggaggaacttcttttgagtttaatgatggtgcaattgcttcgatgatgatcaataaagaagatgagcttcgaactgtgcttcttgaacagtgaaggatttcctcatgacaaattttgattactggcgagaatatttttacttcagaaacagactaccagtcgtaaagtgacattttttggttattgttgagactgcttgcccgtgggctcagaagtgagatttgcattattcttctgttggattctgatagaaaaaaagacattcactgtataagaaaatggatggactgaaccaattagaattgataccagtgaaatttttatattgcttacaattggtaaccaagagtgctgatacctttttaaatttagaggggcaggcttaaataaaggactaaatatttaggatttgaaaaaaaaaaaa

SEQ ID NO: 116 - DNA, 3042 bp, Homo sapiens
  CDS (47)..(2467)
aatcgtggctgactcttcctgcctccggttcttgcctcccagtgccatgcaggtgcaggatgcaaccaggcggccctcagccgtgcgcttcctcagctcctttctccagggccgccggcactccacctcagacccagtactgcggctgcagcaggcccggcggggctctggcttgggctccggctctgccacgaagctgctgtcctcgtcctctctccaggtgatggtggctgtttcctcagtcagccatgcagagggaaacccaactttccccgaaagaaaaagaaatttagaacgtccaacaccaaagtacacaaaagtaggggagcgtttacggcatgtcattcctggacacatggcatgttccatggcgtgtggcggtagagcttgcaagtatgagaacccagcccgctggagtgagcaggagcaagccattaagggggtttactcatcctgggtcactgataatatactggccatggcccgcccatcctctgagctcctggagaagtaccacatcattgatcagttcctcagccatggcataaaaacaataatcaacctccagcgccctggtgagcatgctagctgtgggaaccctctggaacaagaaagtggcttcacataccttcctgaggctttcatggaggctggcatttacttctacaatttcggatggaaggattatggtgtagcgtctcttactactatcctagatatggtgaaggtgatgacatttgccttacaggaaggaaaagtagctatccattgtcatgcagggcttggtcgaacaggtgttttaatagcctgttacttagtttttgcaacgagaatgactgctgaccaagcaattatatttgtgcgggcaaagcgacccaattccatacaaaccagaggacagctcctctgtgtaagggaatttactcagtttctaactcctctccgcaatatattctcttgctgtgatcccaaagcacatgctgtcaccttacctcaatatctaattcgccagcgtcatctgcttcatggttatgaggcacgacttctgaaacacgtgccaaaaattatccacctagtttgcaaattgctgctggacttagcggagaacaggccagtgatgatgaaggatgtgtccgaaggacctggtctctctgctgaaatagaaaagacaatgtctgagatggtcaccatgcagctggataaagagttactgaggcatgacagtgatgtgtccaacccgcctaaccccactgcagtggcagcagattttgacaatcgaggcatgattttctccaatgagcaacagtttgaccctctttggaaaaggcggaatgttgagtgccttcaacccctgactcatctgaaaaggcggctcagctacagtgactcagatttaaagagggccgagaacctcctggagcaaggggagactccacagacagtgcctgcccagatcttggttggccacaagcccaggcagcagaagctcataagccattgttacatcccacagtctccagaaccagacttacacaaggaagccttggttcgcagcacactttctttctggagtcagtcaaagtttggaggcctggaaggactcaaagataatgggtcaccaattttccatggaaggatcattccaaaggaagcacagcagagtggagctttctctgcagatgtttcaggctcacacagccctggggagccagtttcacccagctttgcaaatgtccataaggatccaaaccctgctcaccagcaagtgtctcactgtcagtgtaaaactcatggtgttgggagccctggctctgtcaggcagaacagcaggacaccccgaagccctctggactgtggctccagtcccaaagcacagttcttggttgaacatgaaacccaggacagtaaagatctgtctgaagcagcttcacactctgcattacagtctgaattgagtgctgaggcaagaagaatactggcggccaaagccctagcaaatttaaatgaatctgtagaaaaggaggaactaaaaaggaaggtagaaatgtggcagaaagagcttaattcccgagatggagcttgggaaagaatatgtggcgagagggaccctttcatcctatgcagcttgatgtggtcttgggtggagcaactgaaggagcctgtaatcaccaaagaggatgtggacatgttggttgacaggcgagcagatgccgcagaagcactttttttattagagaagggacagcaccagactattctctgcgtgttgcactgcatagtgaacctgcagacaattcccgtggatgtggaggaagctttccttgcccatgccattaaggcattcactaaggttaattttgattctgaaaatggaccaacagtttacaacaccctgaagaaaatatttaagcacacgctggaagaaaaaagaaaaatgacaaaagatggccctaagcctggcctctagctttcactcgtggtgaatatttcagacctaaagatccagatagtatctctgttcatatgtgaataagttgaagattgtggggctactttttctcatagcactttattttgaatgttgttagtttgtgctgagaatggtcgtccgtatttgaaccaattatttattttaaaatatatttaagctacatttttgttttgaaaaattgccataaatttggtgccactttcttttatttatttgactgagttaatattattgtattaacattttaagtatatggtgtttacattcttatttcttttgacattttggaaataatcataacttgtctttccaaaataaccattttcttgatggaactcttcctagagtttttaccaaatagctaactttagtagtaaaacctcattgtgtatccattcccccacagatgaactaagaaagtcaccaagtgtcttaagctgttttatatttgttacgaagaaggctattgctacaatatttttaaaggtttcttttttaactttgaaaatttttggttttccttttctttttaataaaggtccagaaggttt

SEQ ID NO: 117 - DNA, 3139 bp, Homo sapiens
  CDS (198)..(1967)
cgacgatttcgtgcggtggcgggcgggggcctctggtatccctggtgacgctgtatctgtgggctcttgaatcgcgtcacaaatcagcgaccgaactctggcggtggtggttaagacggcgaaggcggcagcggcggcgacagctctggggtttgcgtctcggggtgtgtcggccgccgctgctgcttgggcctggtatgtacagatggctggttaggattctcggcaccattttccgtttctgcgaccggtcggtgccccctgcccgggccctcctgaagaggcggcgctcagacagcactctgttttctacagtggacactgatgaaataccagccaaaagaccaagattagattgctttattcaccaagtgaaaaacagtctctacaatgctgccagcttatttggattcccattccagctgaccacaaagcccatggtaacttctgcttgtaatggaacacggaatgtggccccttcaggagaggtattttcgaactcttcatcttgtgaactgacaggttctggatcctggaacaacatgctgaaactgggtaataaatctcctaatggaataagtgactatccaaagatcagagtgacagttacccgagatcagccacgcagagtcctgccttcctttggttttactttgaactcagaaggctgtaatagaagaccaggtggccgtcgccatagcaaaggtaatccagagagttctttaatgtggaaacctcaggaacaggctgtaacagagatgatttctgaagagagtggcaagggtctgaggcgtccccattgtactgtggaggagggtgttcaaaaagaggaaagagagaagtaccgaaagttattggaacgacttaaagaaagtggtcatggaaactctgtctgtcctgtaacttcaaattatcacagttctcaaagaagtcagatggacacattaaagaccaaaggctggggggaagagcaaaatcacggagtcaaaacaactcagtttgttccaaaacaatatagacttgttgaaacaaggggacctctatgttcattgagaagtgaaaagaggtgttcaaaggggaaaattactgatacagagacgatggtcggaatcagatttgaaaatgaaagtaggaggggataccaactggagcctgacctatcagaagaagtgtcggcccgactccgcctgggcagtggaagcaatggcttactcaggaggaaagtgtcaataattgagacaaaggaaaagaattgctcaggcaaagagagggacagaagaacggacgatctccttgaacttacagaggacatggaaaaggaaatcagtaatgccctaggccatggcccacaggatgaaatcctaagtagtgctttcaaattgcgaattactcgaggagatattcagacattaaagaactatcactggctcaatgatgaagtcattaatttttacatgaatcttctggtggaaagaaataaaaagcaaggctatccagcacttcatgtattcagtactttcttctatcctaaattaaagtctgggggttaccaagcagtgaaacgatggaccaaaggggtaaatctctttgaacaagaaattattctggtgcctattcatcggaaggtacattggagcctggtggtgattgacctaagaaaaaagtgtcttaaatatctggattctatgggacaaaagggccacaggatctgtgagattctccttcagtatttacaggatgaaagtaagaccaaaagaaatagtgatctgaatcttttagagtggacccatcacagcatgaaaccacacgagattcctcaacagctgaatgggagtgattgtggaatgtttacttgtaaatatgcagattatatttctagggacaaacctatcacatttactcagcaccagatgcctctcttccggaagaagatggtgtgggaaatccttcatcagcagttgctgtgagaaaactttgcctggtccctctagctgctggtggttctttcacagacatttccatatacctcatgcattgtgggttaaaaagtccctgcatcacttctgttctcacaggtactgagctgtcaaaagtgcatgaaggcctctcactgtactctagtcctgacttggggtgcagagggctgcttgcaatcctgtttgtaaggctgtgcctgctcagagctttggactgttcaacccacacaagaacaaacgctaactaatattttttttaagagattcttttccctatgaatgtgggaaatgcaggatttattctgtgaattgtttgtttctgtgtgtttgttcagcgtattcattcactcactcgtttgcaaacataatgggcagtggtcatttactgctgctcttttacagttagctctaaattacttgtttgaactatttatttctgaaaggaatgttactcaagctgccactccctgctgaagagcaggagggaactctcactgggggcggaaggaagtggagctggagcagtaactgccaacatgaagctggagggtttgggattttttttgtttttgtttttttgaggctcaaaaaatgctgggagaaatgaaaatgctgtgggatagggctcctgttgcctttcagaggaagtctgacactacagcgttggcacagtgccgtgaacagtggaactgtgcccaagggactctgactatccaagcatcttccgaagagtgttgtggtcaccttaaagagacttccctttctggaaatgtggtgacttggcttagtcttcaaactggattcatggatttgaagtaactgtaaaccctaaatcttcattttcatcccagatctggttgagtataaacctcagaattgtaggggctggcctgagctgtttatttcaaaagatactattcaatttaaagctatttttcctcagagtttttgttttctatatattaagtctaaattaagttttctactcattaagactaacatctccccactccatccccactgaaatttgtggaagaaaatttagtacttggctctgaggttgccagttatacaataatctattttgcatatgaaagtttgtatttaacttttttgttcattaaaaaccttactgatatggttataacttcaaaaaaaaaaaa

SEQ ID NO: 118 - DNA, 3664 bp, Homo sapiens
  CDS (41)..(2911)
catcatccctgataactccctcctcattcccagaaaatggatgctatccagtcacttctacttctgtgcctaccctgcggcagaacatggagaaaggtacaacttatccttaaggaatttccaggataactttgaccacataatcgataagaaaatgtctgatgctcagggcagctacaaactggatgaagctcaggctgtcttgagagaaacaaaagccatcaaaaaggctattacctgtggggaaaaggaaaagcaagatctcattaagagccttgccatgttgaaggacggcttccgcactgacagggggtctcactcagacctgtggtccagcagcagctctctggagagttcgagtttcccgctaccgaaacagtacctggatgtgagctcccagacagacatctcgggaagcttcggcatcaacagcaacaatcagttggcagagaaggtcagattgcgccttcgatatgaagaggctaagagaaggatcgccaacctgaagatccagctggccaagcttgacagtgaggcctggcctggggtgctggactcagagagggaccggctgatccttatcaacgagaaggaggagctgctgaaggagatgcgcttcatcagcccccgcaagtggacccagggggaggtggagcagctggagatggcccggaagcggctggaaaaggacctgcaggcagcccgggacacccagagcaaggcgctgacggagaggttaaagttaaacagtaagaggaaccagcttgtgagggaactggaagaagccacccggcaggtggcaactctgcactcccagctgaaaagtctctcaagcagcatgcagtccctgtcctcaggcagcagccccggatccctcacgtccagccggggctccctggttgcatccagcctggactcctccacttcagccagcttcactgacctctactatgacccctttgagcagctggactcagagctgcagagcaaggtggagttcctgctcctggagggggccaccggcttccggccctcaggctgcatcaccaccatccacgaggatgaggtggccaagacccagaaggcagagggaggtggccgcctgcaggctctgcgttccctgtctggcaccccaaagtccatgacctccctatccccacgttcctctctctcctccccctccccaccctgttcccctctcatggctgaccccctcctggctggtgatgccttcctcaactccttggagtttgaagacccggagctgagtgccactctttgtgaactgagccttggtaacagcgcccaggaaagataccggctggaggaaccaggaacggagggcaagcagctgggccaagctgtgaatacggcccaggggtgtggcctgaaagtggcctgtgtctcagccgccgtatcggacgagtcagtggctggagacagtggtgtgtacgaggcttccgtgcagagactgggtgcttcagaagctgctgcatttgacagtgacgaatcggaagcagtgggtgcgacccgaattcagattgccctgaagtatgatgagaagaataagcaatttgcaatattaatcatccagctgagtaacctttctgctctgttgcagcaacaagaccagaaagtgaatatccgcgtggctgtccttccttgctctgaaagcacaacctgcctgttccggacccggcctctggacgcctcagacactctagtgttcaatgaggtgttctgggtatccatgtcctatccagcccttcaccagaagaccttaagagtcgatgtctgtaccaccgacaggagccatctggaagagtgcctgggaggcgcccagatcagcctggcggaggtctgccggtctggggagaggtcgactcgctggtacaaccttctcagctacaaatacttgaagaaacagagcagggagctcaagccagtgggagtcatggcccctgcctcagggcctgccagcacggacgctgtgtctgctctgttggaacagacagcagtggagctggagaagaggcaggagggcaggagcagcacacagacactggaagacagctggaggtatgaggagaccagtgagaatgaggcagtagccgaggaagaggaggaggaggtggaggaggaggagggagaagaggatgttttcaccgagaaagcctcacctgatatggatgggtacccagcattaaaggtggacaaagagaccaacacggagaccccggccccatcccccacagtggtgcgacctaaggaccggagagtgggcaccccgtcccaggggccatttcttcgagggagcaccatcatccgctctaagaccttctccccaggaccccagagccagtacgtgtgccggctgaatcggagtgatagtgacagctccactctgtccaaaaagccaccttttgttcgaaactccctggagcgacgcagcgtccggatgaagcggccgtccccacccccacagccttcctcggtcaagtcgctgcgctccgagcgtctgatccgtacctcgctggacctggagttagacctgcaggcgacaagaacctggcacagccaattgacccaggagatctcggtgctgaaggagctcaaggagcagctggaacaagccaagagccacggggagaaggagctgccacagtggttgcgtgaggacgagcgtttccgcctgctgctgaggatgctggagaagcggcagatggaccgagcggacgacaagggtgagcttcagacagacaagatgatgagggcagctgccaaggatgtgcacaggctccgaggccagagctgtaaggaacccccagaagttcagtctttcagggagaagatggcatttttcacccggcctcggatgaatatcccagctctctctgcagatgacgtctaatcgccagaaaagtatttcctttgttccactgaccaggctgtgaacattgactgtggctaaagttatttatgtggtgttatatgaaggtactgagtcacaagtcctctagtgctcttgttggtttgaagatgaaccgactttttagtttgggtcctactgttgttattaaaaacagaacaaaaacaaaacacacacacacacaaaaacagaaacaaaaaaaaccagcattaaaataataagattgtatagtttgtatatttaggagtgtatttttgggaaagaaaatttaaatgaactaaagcagtattgagttgctgctcttcttaaaatcgtttagattttttttggtttgtacagctccaccttttagaggtcttactgcaataagaagtaatgcctgggggacggtaatcctaataggacgtcccgcacttgtcacagtacagctaatttttcctagttaacatattttgtacaatattaaaaaaatgcacagaaaccattgggggggattcagaggtgcatccacggatcttcttgagctgtgacgtgtttttatgtggctgcccaacgtggagcgggcagtgtgataggctgggtgggctaagcagcctagtctatgtgggtgacaggccacgctggtctcagatgcccagtgaagccactaacatgagtgaggggagggctgtggggaactccattcagttttatctccatcaataaagtggcctttcaaaaagaaaaaaaaaaaaa

SEQ ID NO: 119 - DNA, 1248 bp, Homo sapiens
  CDS (70)..(1191)
tttcgtggaagctagggttagaggcaacccgtgaggctagaaccccgaacgtggtcggttggagcaaatatgtccctccggaggcacattgggaaccctgagtatctgatgaaaaggataccacagaacccaagataccagcatatcaaatcaagactggacactggtaacagtatgactaaatatactgagaagctcgaagagattaagaaaaattatagatacaaaaaagatgagcttttcaagagactaaaagttacaacttttgcccagctgatcatccaagttgcttccctctctgatcaaacactggaagtgacagctgaggagattcaaaggctggaagacaatgattctgcagcttcagaccctgatgctgaaaccactgccaggaccaatgggaaaggaaatccaggtgagcagtcgccgagccctgagcagttcataaacaacgcaggagcaggggactccagccgctcaactcttcagagtgtcatcagtggtgttggggaactggatctagacaaagggccagtgaagaaagcagagccccataccaaagacaaaccttatcctgactgccccttcctgctgctagatgtgcgtgatagagattcttaccagcagtgccacattgttggagcttacagttacccaattgcaactctgtctagaacaatgaacccttattcaaatgatattcttgaatataaaaatgcccatggcaagatcatcattctgtatgacgatgatgaaaggctggccagtcaggcggccaccaccatgtgcgagcgtggatttgaaaacctcttcatgctttccggaggtctaaaagtcttagctcagaaattcccggaaggactgattactggttccctgccagcatcttgccagcaggcccttcctcctgggtctgcccggaaacgatccagccccaaagggccacccctaccagctgagaataaatggagatttaccccagaagacttaaaaaagatagaatattatctggaagaggagcaagggcctgcagatcatcctagccgactgaaccaagctaactcctccggaagagagtccaaggtgcctggtgcccgaagcgctcagaatctgccaggtggcggccccgccagccactcaaacccccgctccctcagcagtggtcacctgcaaggcaaaccctggaagtaaagactttgtctcacttaggcaaataaatgttcttcctcttttcagaaaaaaaaaaaa

SEQ ID NO: 120 - DNA, 6202 bp, Homo sapiens
  CDS (49)..(4890)
gaccgggacacagataagaaacgaattgaggagctgctggaagaaaacatggtccttgagattgcacagaagcagagcatgaacgaatctgcccaccttggctgggagctggagcagctgtccaagaacgcagacttgtcagacgcctccaggaagtcgtttgtgtttgagctgaacgaatgtgcgtccagccgcatcctgaagctggagaaggagaatcagagcctccagagcaccatccaggggctgcgggacgcgtccctggtgttggaggagagcggcctcaagtgcggggagctggagaaggagaaccaccagctcagcaagaagattgaaaagttacaaacccagctggagagagaaaagcagagcaaccaagatctggagaccctcagtgaggagctgatcagagagaaggagcagctgcagagtgacatggagaccctgaaggctgacaaagccaggcagatcaaggaccttgagcaggaaaaggaccacctcaaccgagccatgtggtcgctgcgggagaggtcgcaggtcagcagtgaggcccgcatgaaagacgtggagaaggagaacaaagccctccaccagacggtgacggaggccaatggcaagctcagccagttggagtttgagaagcggcagctgcacagggacttggagcaggccaaggagaagggggagcgggcagagaagctggagagagagctacagcgactccaggaggagaacgggaggctggccaggaaggtgacctccctggagacagccaccgagaaagtcgaggccctggagcatgagagccagggcctgcagctggagaaccggactctgaggaagtctctggacaccttgcagaacgtgtccctgcagcttgagggcctggagcgtgacaacaagcagctggacgcagagaacctggagctgcgcaggctggtggagaccatgcgcttcaccagcaccaagctggcacagatggagagggagaaccagcagctggagcgtgagaaggaggagctgaggaagaacgtggatctgctcaaggcgctgggcaagaagtcagagcgcctggagctcagctaccagagcgtgagcgctgagaacctccggctgcagcagagcctggagagcagcagccacaagacgcagaccttggagagtgagctgggcgagctggaggctgagcgccaggcgctgcggcgggacctggaggccctccggctggccaatgcacagttggagggggccgagaaggacaggaaggccctggagcaggaggtggcccagctcgagaaggataagaagctgctggagaaggaggccaagcggctgtggcagcaggtggagctcaaggatgcagtcttggacgatagcactgccaaactgtccgccgttgagaaggagagccgcgcgctggacaaggagctggcccgctgcagggacgcagccggcaagctgaaggagctggagaaggacaaccgggacctcaccaagcaagtcaccgtgcatgcaaggacactgacaactctgagggaggacctggtgctcgagaagctgaagagccagcagctcagcagtgagctggacaagctgagccaggaactggagaaggtcggcctcaacagggagctgctgttgcaggaggacgacagcggcagtgacacaaaatacaagattttggagggcagaaatgaatcagcattaaaaacaacactagccatgaaagaagaaaagattgtgctcttagaagcacagatggaagagaaagcgagcctaaatcgccagttagagagtgagctgcagatgctgaagaaggagtgtgagaccctcaggcagaaccagggagaggggcagcacttgcagaactctttcaagcaccctgcggggaagacagccgccagtcaccaggggaaggaggcctgggggcccggccataaggaagccaccatggagcttctccgagtgaaggaccgggccatcgagctggagcggaataatgcagctctgcaggctgagaagcagctgctaaaggaacagctgcagcacctggagacccagaacgtgaccttcagcagccagatcttgacactgcagaaacagagcgccttcctgcaggagcacaacaccacactgcagacccagaccgccaagctgcaggtggagaactccacgctgagttcccagagcgcagcgctcaccgcgcagtacacgctgctgcagaaccaccacacggccaaggagacggagaacgaaagcctgcagaggcaggagaggcaacttacagcggcctacgaggccctgctgcaggaccacgagcacctgggcacgctgcacgagcggcaatcggccgagtacgaggccctcatccgccagcacagctgcctaaagacactgcatcggaatctggagctggagcacaaggagctcggggagaggcacggtgacatgctgaagcgcaaggcggagctggaggagcgggagaaggtcttgaccactgagcgagaggcgctgcagcaggagcagaggacaaacgccctcgccatgggcgagaaccagaggctgcggggcgagctggacagggtcaatttcctgcaccaccagctgaagggggagtacgaggagctgcacgcccacaccaaggagctgaaaacctcactgaacaacgcgcagctggagctcaaccgctggcaggcccgcttcgacgagctgaaggagcagcaccagaccatggacatctcgctgaccaagctggacaaccactgtgagctgctctcccgtctcaaggggaacttggaggaagaaaatcatcacctcctgagccagatccagctgttgagccagcagaaccagatgcttctggagcagaacatggagaacaaggagcagtaccatgaggagcagaagcagtacatagacaaattaaatgccttacgaagacataaggaaaagctggaagaaaaaatcatggatcaatacaagttctatgatcctcctccaaagaagaagaaccactggattggagccaaagccttagtcaaactcatcaaaccaaagaaagagggttcgagggaacgcttaaaatccaccgtggacagccctccctggcagctggagtcctcagaccccgcctcgccggcggcctctcagccgctcagatcacaggccgagaaccccgacacccccgcactgggctccaactgtgcagaagagcgcgacgcccacaacgggtctgtggggaaaggccctggggatctaaaaccaaagcgaggctccccacacagaggcagccttgaccgcacagatgcctccaccgatctggccatgaggtcctggccctcggagctgggctcccggacttgctcaacttcagccaccactacagccccttccaactccacccccatcgcccggcacccaggccgcaccaaaggctataactcagatgacaacctctgtgagccatccctggagtttgaggtccccaaccacaggcagtacgtgtcgcggccaagtagcttagagagcagtagaaacacatccagcaacagctcacctcttaacctaaaaggctcctccgagcagctccatggccggtctgagagcttcagcagcgaagacctgatccccagcagggacctggccactttgccccgggaagccagcacaccgggacgcaacgccctcggccgccacgagtaccccttgcctcggaacgggcctctcccacaggagggtgcccagaagaggggcacagcccctccctacgtcggagtgcggccctgctcggcctcccccagcagtgagatggtcaccttggaggagttcctggaggagagcaaccgcagctcccccacccatgacactcccagttgccgggatgacctgctgagtgactacttccgaaaggccagcgatcccccagccatcggaggccaaccaggaccacctgccaagaaagaaggggccaagatgcccaccaactttgtggcccccaccgtcaaaatggccgcccccacctcggaggggaggccgctgaagcccgggcagtacgtaaagccaaacttcagactgactgaggccgaggccccacccagcgtggccccgagacaggcccagcctccccagagcctgtctctgggcagaccccggcaggctccggtgcccccagcttcccatgcacctgccagccgcagtgcctccttgagccgggccttcagcctggcctcagctgaccttctccgggccagcgggccagaggcctgcaaacaggagtcccctcagaagctgggggctcctgaggccttagggggcagagagacaggcagccacaccctgcaaagccccgcaccccccagctcccatagcctggcccgggagcggaccccacttgtgggaaaggctggcagctcctgtcagggcccaggtccccgcagccggccgctggacacgaggcgcttctccctggctcccccaaaggaggagaggctggcccccctgcatcagtctgccacagcccccgccattgccactgcaggtgctggtgctgctgctgctggcagtggcagcaactcccagctcctgcacttctcacctgctgcagccccggctgccaggaccaagcccaaggcgcccccacgctcaggggaggtggccaccatcacccctgtccgggcagggctcagcctctcagagggagacggggtcccggggcagggctgcagtgaggggcttccggccaagagcccaggtcggtctcccgatttggctccccacctcggccgggccctggaggactgcagtcgagggagcgtctcaaagagcagtccggcctccccggagcccggcggggatccgcagaccgtgtggtatgagtacggctgtgtgtgactgtctcgtggttgagctcgcaaacctgaaaactactgacgcgccttccgactctcacggccttttctcttgcttgcctgcggtgccaggagagggtttggaatgaggaaaggggttcccacgcatttctgctgtttgttctgtgaatggaaacactgtgccaagccccaagaggattacgcttccaggtgtgtaacgtgttttctgtgtctgccgcttccagcagctgatatctttggaacaaataatccacgtcagcatggggaccaattcggatgcaatgacaaactgacttcccccaaagcagacactactccagtatgtcccagtagaacactcatttgcaatgtgttgagctccgttaagcacacacacactcacacaacaggctcacgaggctcaggcctggcgggtcagaaagcccactccctctcccaaggccactggatcccaggagaagcccagactggcgatactacaaaggtctccagggcctggcagaccccagagtcaggcctgctgttaaaaagtgagagtgctgctgttccattcctggggtcccaagcacttccctttaccccaggacccagggcagcctgcagggcagctggcggtggccttggccatttgcccccagcctccagctggctcctgagctctgcaccagggggtttggggaccacacaggcacctgccttcctagatttccctggctcacttttctgcaaacactggatctgccaggcctggggattggggggcaggaaagaggcccccatccagccccctccaggccagtgtgcacagtgcaccgaggggtcatccgcacagagcgaggtgcaagctcgatgtgtaacctggctgcggcacccgacatccccggtctcggggtgttgatttatttctgaataactttttgggtatagaaaccaattttttttaatatatgacatgtatatgtacacactcatgtgaaatatgtatactttggggggatctatttatgttccagtgggagtcactctcttctgtcgggaatcttatctgctgctttgtgtctttggtcagattcctgacaatttagtttcctgttgtaaaggtgcttttcctggggtgaactaaacctattgattttttttttttaagatttttttttccttttgatttaatatactgagaaagaaatgggagacttttgaatgttaacaagatccattttaggagtgtttggggttgtgtattaaatagccattcattctggaactcaaggacaggactgtaataaaatggaatggaaccgaaaaaaaaaaaa

SEQ ID NO: 121 - DNA, 2844 bp, Homo sapiens
  CDS (105)..(2048)
agcgcgtggctgggcgtcagcgcggtggccagcgcgcagaggcgggcgcggaggcggctagaaggtgaccgcggatcccagcttcctgcagccagccctgaaggatggctgccatattgggagacaccatcatggtggctaaaggccttgtcaagctgacccaggcggccgtggaaacccacctgcagcacttgggcatcggaggggagctgatcatggcggccagggccctgcagtccacggctgtggagcagattggcatgttcttggggaaggtgcagggtcaggataaacatgaagaatattttgctgagaacttcggcggcccagaaggggagttccacttctcagtcccgcatgcagccggagcctccacagacttctcttcagcctccgctcccgaccagtcagcgcccccatccctgggtcatgcccacagcgagggcccagctcctgcctacgtggccagtggaccctttagagaagccgggttccccggccaggcctcctcccctctgggcagggccaacgggaggctctttgcaaaccccagagactcattctctgccatgggctttcagcgaaggttcttccaccaggaccaatcccctgttgggggcctcacagccgaggacattgagaaggcccggcaggctaaggctcgccccgagaacaagcagcacaaacagacgctcagcgagcatgcccgggagcggaaggtgcctgtgacgaggattggccggctggccaacttcggaggtctggccgtgggcctgggcttcggggcactggcagaggtcgccaagaagagcctgcgctccgaggacccctcagggaagaaggccgtgctgggttccagtcctttcctgtccgaggccaatgcagagcggatcgtgcgcacgctctgcaaggtgcgtggtgcggcactcaagctgggccagatgctgagcatccaggatgatgcctttatcaacccccacctggctaagatcttcgagcgggtgcggcagagcgcggacttcatgccactgaagcagatgatgaaaactctcaacaacgacctgggccccaactggcgggacaagttggaatacttcgaggagcggcccttcgccgccgcatccattgggcaggtgcacttggcccgaatgaagggcggccgcgaggtggccatgaagatccagtaccctggcgtggcccagagcatcaacagtgatgtcaacaacctcatggccgtgttgaacatgagcaacatgcttccagaaggcctgttccccgagcacctgatcgacgtgctgaggcgggagctggccctggagtgtgactaccagcgagaggccgcctgtgcccgcaagttcagggacctgctgaagggccaccccttcttctatgtgcctgagattgtggatgagctctgcagcccacatgtgctgaccacagagctggtgtctggcttccccctggaccaggccgaagggctcagccaggagattcggaacgagatctgctacaacatcctggttctgtgcctgagggagctgtttgagttccacttcatgcaaacagaccccaactggtccaacttcttctatgacccccagcagcacaaggtggctcttttggattttggggcaacgcgggaatatgacagatccttcaccgacctctacattcagatcatcagggctgctgccgacagggacagggagactgtgcgggcgaaatccatagagatgaagttcctcaccggctacgaggtcaaggtcatggaagacgcccacttggatgccatcctcatcctgggggaggccttcgcctccgatgagccttttgattttggcactcagagcaccaccgagaagatccacaacctgattcccgtcatgctgaggcaccgtctcgtccccccacccgaggaaacctactccctgcacaggaagatggggggctccttcctcatctgctccaagctgaaggcccgcttcccctgcaaggccatgttcgaggaggcctacagcaactactgcaagaggcaggcccagcagtagggctgcgggccacgcccaggccggctccgcgggaactctctccctcagacaggccaaaaaccagtagcgaggtcgtggtgatgctctttttaactcctttgcccaataaggggggtggctgcctggagccccgtagccagcgctttccacggtttctgttgctaaatggttgtagggtgagaagtgcaagaatgaagatgaagccccactgctcggtcagtctgcctccgtgtgtcctctgaaataagcagatgaagatgaaagggcaactttgttttcttctttttcctgatgtgaatgttaagcagaagggagagagtccttactcccttccaatctctgttcagtgcaaaacccagaaacatgaacagatacgattgtgggatttttatcatctgtgtagtaggtgtgtgtatgtgtttctagagtgagatttgtgttttctgcccttttcctctccagccgatgggctggagctgggagaggtgctgagctaacagtgccaacaagtgctccttaagcctgcgaggcccaggcctgtggggctggttctcacctttgacagctgaatgttcctaaagaactgctgccccacagtgagggtgggagcagcggaacagggaatgccagacacaggctcgctgctgctggaaggcggggtgggacttccttcctctgtccggagaggcacaggtgtcaccagttccagccaaaggctcctcacaggcgctgtgaatttttgtacaagtcttgtaattatcgaatcaacaacttgttgcaattttaattaaaattg

SEQ ID NO: 122 - DNA, 4179 bp, Homo sapiens
  CDS (482)..(2284)
tggagacgtttcagctccacaccattcagtatgggagacgccagccccacggggctacggtgcaagcagataactgaatttcgaagtgcctcctctgggcttctcccagctgcctttgtgtcctctatcccagctcccatcacccctggtcacacaatccacctcctcctttggacttcgagctccgtgtcggtggatagtgtggctttgctggggtcccggctgtgtccccagcacccaccacacggctggcacacaggctccgcgagcgccggacggacggactacaattcccgacaggcagcgcggctggcggggcggttcgccgcggtgcccacaggacctcagggcgagtgcgggctgccccgcgcggcgcccgcaggaccccggcggctacccatgccgaggtgagtccgcgggagccgccgccgccgccgtcccgtcccagctgccgccccgcgcggccccgccgccggccaggatgctggaggaagcgggcgaggtgctggagaacatgctgaaggcgtcttgtctgccgctcggcttcatcgtcttcctgcccgctgtgctgctgctggtggcgccgccgctgcctgccgccgacgccgcgcacgagttcaccgtgtaccgcatgcagcagtacgacctgcagggccagccctacggcacacggaatgcagtgctgaacacggaggcgcgcacgatggcggcggaggtgctgagccgccgctgcgtgctcatgcggctactggacttctcctacgagcagtaccagaaggccctgcggcagtcggcgggcgccgtggtcatcatcctgcccagggccatggccgccgtgccccaggacgtcgtccggggacagtcactgggccccctgctacccccaccagggacagtcactgggccccctgctaccttgccacccccaccaggccagcagccccctaagtgtgtgtctgctccacagcaattcatggagatcgagccggagatgctggccatggagaccgccgtccccgtgtactttgccgtggaggacgaggccctgctgtctatctacaagcagacccaggctgcctccgcctcccagggctccgcctctgctgctgaagtactgctgcgcacggccactgccaacggcttccagatggtcaccagcggggtacagagcaaggccgtgagtgactggctgattgccagcgtggaggggcggctgacggggctgggcggagaggaccttcccaccatcgtcatcgtggcccactacgacgcctttggagtggccccctggctgtcgctgggcgcggactccaacgggagcggcgtctctgtgctgctggagctggcacgcctcttctcccggctctacacctacaagcgcacgcacgccgcctacaacctcctgttctttgcgtctggaggaggcaagtttaactaccagggaaccaagcgctggctggaagacaacctggaccacacagactccagcctgcttcaggacaatgtggccttcgtgctgtgcctggacaccgtgggccggggcagcagcctgcacctgcacgtgtccaagccgcctcgggagggcaccctgcagcacgccttcctgcgggagctggagacggtggccgcgcaccagttccctgaggtacggttctccatggtgcacaagcggatcaacctggcggaggacgtgctggcctgggagcacgagcgcttcgccatccgccgactgcccgccttcacgctgtcccacctggagagccaccgtgacggccagcgcagcagcatcatggacgtgcggtcccgggtggattctaagaccctgacccgtaacacgaggatcattgcagaggccctgactcgagtcatctacaacctgacagagaaggggacacccccagacatgccggtgttcacagagcagatgcagatccagcaggagcagctggactcggtgatggactggctcaccaaccagccgcgggccgcgcagctggtggacaaggacagcaccttcctcagcacgctggagcaccacctgagccgctacctgaaggacgtgaagcagcaccacgtcaaggctgacaagcgggacccagagtttgtcttctacgaccagctgaagcaagtgatgaatgcgtacagagtcaagccggccgtctttgacctgctcctggctgttggcattgctgcctacctcggcatggcctacgtggctgtccagcacttcagcctcctctacaagaccgtccagaggctgctcgtgaaggccaagacacagtgacacagccacccccacagccggagcccccgccgctccacagtccctggggccgagcacgagtgagtggacactgccccgccgcgggcggccctgcagggacaggggccctctccctccccggcggtggttggaacactgaattacagagcttttttctgttgctctccgagactggggggggattgtttcttcttttccttgtctttgaacttccttggaggagagcttgggagacgtcccggggccaggctacggacttgcggacgagccccccagtcctgggagccggccgccctcggtctggtgtaagcacacatgcacgattaaagaggagacgccgggaccccctgcccgatcgcgcgcgggctccgcccaccgcctcctgccgcaaggggcctggactgcaggcctgacctgctccctgctccgtgtctgtcctaggacgtcccctcccgctccccgatggtggcgtggacatggttatttatctctgctccttcttgcctggaggagggcagtgccagccctggggttctgggattccagccctcctggagccttttgttccccatgtggtctcagtgacccgtccccctgacagtgggctcggggagctgcatcacccagccttccccttctccgactgcagggtctgatgtcatcgttgacagcctttgcttcgtgggggcctggcagggcccctgcctccccgacccccgacccactgcaaacccccgttcccctgcactcctcttctcccagcccatccctccggcccctgtgcctctgcggccccagcccagctcccagggccgtcacctgcttggccctggcccagctccctgccctgagtcctgagccagtgcctggtgtttcctgggctcggtactgggcccccaggccatccaggctttgccacggccagttggtcctccctggggaactgggtgcgggtggagtactgggaggcaggaggtggcccggggaggccttgtggctcctcccctcgctcctcgccctgggcctcagcttcctcatcaatagaaaggatgtgttcggggtgggggcgtcaggtgagaacgtttgctgggaaggagaggacttggggcatggcctctggggccacccttcctggaactcagagaggaaggtccgggccctcgggaagccttggacagaaccctccaccccgcagaccaggcgtcgtgtgtgtgtgggagagaaggaggcccgtgttgagctcagggagaccccggtgtgtccgttctttagcaatataacctacccagtgcgtgccgagcaggcttggtggggaagggacttgagctgggcaagtcctggcctggcacccgcagccgtctcccttccgtggcccagggaggtgtttgctgtccgaaggacctgggccggcccatgggagcctggggttctgtccagataggaccagggggtctcactttggccaccagttcttcggccagcacctctgccctccagaacctgcagcctggaggggtgaggggacaaccacccctctttcctccaggttggcaggggaccctcttctcccgtctgccctgcgggttgcccgcctcctccagagacttgcccaagggcccatcaccactggcctctgggcacttgtgctgagactctgggacccaggcagctgccaccttgtcaccatgagagaatttggggagtgcttgcatgctagccagcaggctcctgtctgggtgccacggggccagcattttggagggagcttccttccttccttcctggacaggtcgtcaggatggatgcactgactgaccgtctggggctcaggctggtgtgggatgcagccggccgatgagaaaataaagccatattgaatgatcaaaaaaaaaaaa

SEQ ID NO: 123 - DNA, 2511 bp, Homo sapiens
  CDS (142)..(1365)
gattttctgctccggttggtgagcgcgcctgcgcgttgacggcgattttgcgttctgaggctgcagcgtcggcatcttgagctgccggttcgcgagttcgaggccaggttccgcctgtcgtgggttcgcaccccggacgcgatgctattcgacaaggtgaaagcgttctcggtgcagttggacggcgcgaccgcgggcgtcgagcccgtgtttagcggcggccaggccgtggcgggccgggtgctgctggagctgtcaagcgccgcgcgtgtgggtgccctgaggctgcgcgcgcggggccgcgcccacgtgcactggaccgagtcgcgcagcgcgggctcgagcacggcttacacgcagagctacagtgaacgcgtggaggtcgtgagccaccgcgccacgctcctggcgccagataccggggagaccacgacgctgcctcctgggcgccatgagttcctgttcagcttccagctgcccccgaccctggtgacatccttcgagggcaaacacggtagtgtccgctactgtatcaaggccaccctgcaccggccctgggtcccagcacgccgggcaaggaaggtgttcactgtcatcgagcctgtggacatcaacacgccagccctgctggcacctcaagcgggggctcgggaaaaggttgcccgatcctggtactgtaaccgtggcctagtctccctttcggccaagatcgaccgcaagggctacaccccaggagaggtcatccctgtctttgccgagatcgacaacggctccacacgtcctgtgctgcctcgggcagccgtggtgcagacacagacgttcatggcccgaggcgcccgaaagcagaaacgggcagtggtggccagcctcgcgggcgagccggtgggccccgggcagcgggcgctgtggcagggccgggcactgcggatccccccagtgggtccttccatcctgcactgccgcgttctacacgtggactacgcactcaaggtctgtgtggatatcccaggaacgtccaagctgctgctggagctgccactggtgatcggcaccattcccttgcacccttttggcagccgttcctccagcgtgggcagccacgccagcttcctgctggactggaggctgggggccttgccggagcggcctgaggctcctcctgagtactcggaggtggtagccgacactgaggaggcagccttggggcagagccccttcccgcttccgcaggaccccgacatgagccttgaaggcccgttcttcgcctacatccaagagttccgctaccgcccgccacccctgtactctgaggaggatccaaacccactcttgggggacatgaggccgcgctgcatgacttgctgaacggcacagggacccctcgaggaacaaggttgcacaccagctttcagccaccatgactgtggggagtggctggaccaagggctgacctccccgactgcatcaaagttggggaaccaagtctcagagtgaggcgggggcctttcggatatcacatgggacagaggaagagcccggctggaatctgacttacctggaccgctgtccttgtgaggcattgaatgcccagtgcagtatccgagagactgtttaataacctgtcttcccagccaattggtggtgctggaatcccctaggagccttcagtctgggagaaacagagccagacatagacagttccagcatcacagaaccagaagaagagacctgcaactgtgagagtccagacaggaagcagagaaggcgtccttgcggaaagggcattttagctgaggctttggagtacgaataggagctcagcaggcagacgaatgaggaataaaggtcagagaaggtcagagctgagtgacgtttggaatccaccccgtttattgtagaactgggggttcagagggcaggtgcctcagagttgaggccacacagtgaggtctggtgggtgaaaggacccaggaacgaggcgttcaggaaagcaggttgtcagagctatgtggagtctgtgggtggcaggggcagccgctccagcctttgaagactttgaaagccagagattcctggcgcaggcttggacttcctgggagctcctccaagtacccaggggcatcagagctgcctgggtgttacatggcccagggaacccaggttcagggtaggacaggcaagaccagatacccaatgtgcaaagtgaaaacactgggctccctgttaaacgatgaagaattcaagacagtgacagcattacgtcacccctggggacagaggtcagcctaaggtgacacacggggactactgtgcttccggaggctccctgtgtcctggaggagaaaagcattagagggggcagctggacaagctcccaactgcagagtcccagccctggctggggcagggccccggcctgggactcagcatttctgatatgccttaagaattcattctgttttgtacaattattttttaaaagtaaacgtgtggagaaagaaaaaaaaaaaa

SEQ ID NO: 124 - DNA, 787 bp, Homo sapiens
  CDS (56)..(673)
ggcacgaggctcgccgtgagacagcaagtgtcggatccgcaggcgcagccgtgcgatgttgtcctctacagccatgtattcggctcctggcagagacttggggatggaaccgcacagagccgcgggccctttgcagctgcgattttcgccctacgttttcaacggaggaacagacaaaacagtcattggatgcagcggttttcatggagactgtcttacgctgacaaagattattgaagcaagactaaagatgtataagcattccaataataaggccatgactacgggggcaattgctgcaatgctgtctacaatcctgtattcaaggcgcttctttccatactatgtttacaacatcatcggtggacttgatgaagaaggaaagggggctgtatacagctttgatccagtagggtcttaccagagagactccttcaaggctggaggctcagcaagtgccatgctacagcccctgcttgacaaccaggttggttttaagaacatgcagaatgtggagcatgttccgctgtccttggacagagccatgcggctggtgaaagatgtcttcatttctgcggctgagagagatgtgtacactggggacgcactccggatctgcatagtgaccaaagagggcatcagggaggaaactgtttccttaaggaaggactgatctgtgtgctcttatcaccaatcagttcagacctggttgattttgtactttggaactgtaccttggatggttttgtttattaaaagagaaacctgaagtaaaaaaaaaaaaaaa

SEQ ID NO: 125 - DNA, 1423 bp, Homo sapiens
  CDS (394)..(1266)
tttcgtggcggcgctggtgagtttggtgtggtttcttcctcgcgtagctattgttgagttgtcctttgccttcagcggctggaggcaaactgttggtaccagggaagggtggtgatgaaagttgcttcagggaggcggcctccctagagttaccgttcctgtccggtaacccaaggggctggctttaaggcgaatctgtgaacccgagtgtgaaggccccgagtctgggtgtctgacggagagagggcagtttcccaccctagacgttccactttcctataatcctgaggaaagaatgacttttctttacgcctcctctcccttctgtagggggtgctggagtccgacctgccaagtgccgtgacacttctgaaaaatctccaggagcaagtgatggctgtaactgcacaagtgaaatcactgacacaaaaagttcaagctggtgcctatcctacagaaaagggtctcagcttcttggaagtgaaagaccagctgctgctcatgtaccttatggatttgacccacctcattctggacaaagcctcaggaggatctcttcagggacatgatgcagttttgagactggtagagattcgaacggttttggaaaagcttcgtcccttggaccaaaagctgaagtatcaaattgacaagctgatcaagactgcagtgacaggcagccttagtgagaatgacccacttcgttttaagcctcatcccagcaatatgatgagcaagttgagctctgaggatgaggaggaagatgaagcagaagatgaccagtctgaggcttcagggaagaaatctgtgaagggagtgtctaagaaatatgttcctccacgcttggttccagtacattatgatgaaacagaagctgagcgggagaagaagcgtctagaacgagccaagagacgggcattgagcagctctgtcattcgtgaacttaaggagcagtactcagatgctccagaggaaatccgtgatgctcggcatccccatgttacccgccagagtcaggaggaccaacacaggattaactatgaggagagcatgatggtgcgtttgagcgtcagtaagcgagagaaaggacggcgaaaacgagcaaatgtcatgagctcacaacttcattcccttacacacttcagtgacatcagtgctttgacagggggaactgttcatcttgatgaggatcagaatcctattaagaagcggaagaagatacctcagaaaggtcggaagaaaaaaggttttcggaggcggcggtgattatgggtgtacatatttgtatattttttgtcatcctgagatacttctaatttcattgtatataggtggttttccctggaattcattaattgtttgctttggacatgtggaaagagccttactaataaaattgattttacttatgaaaaaaaaaaaa

SEQ ID NO: 126 - DNA, 1221 bp, Homo sapiens
  CDS (4)..(807)
aacatggcggcgcccgttgtcacggccccgggcagagctctgctgcgggcgggcgctggacggctgcttcggggaggcgtccaggagctactgcggccgcgacatgaagggaacgcccctgacctggcctgcaacttcagcctttctcaaaatcggggcacggtcatcgtggagcgctggtggaaggtaccgctggccggggagggccggaagccgcgcctgcaccggcgacatcgcgtctataagctggtggaggacacgaagcatcggcccaaagaaaacctggagctcatcctgacgcagtcggtggagaatgttggagtccggggtgacctggtctcagtgaagaaatctttaggccggaatcgactccttcctcagggactggctgtatatgcatcccctgaaaacaagaagctgtttgaagaggagaaattgctgagacaagaaggaaaattagagaagatccagaccaaggcaggtgaggcgacagtgaaatttctaaaaagctgtcgcctggaggtagggatgaagaacaatgtcaaatgggagctgaaccctgaaatagttgcccgccacttctttaagaatcttggtgttgtggttgccccacatacattaaagttaccagaagagcctatcacacggtggggcgagtattggtgtgaggtgacggtaaatgggcttgatactgtgagagtgcctatgtctgtcgtgaactttgagaagcccaagaccaaaagatataagtactggttagcccagcaagctgccaaggctatggcccccaccagcccccagatctaaatctactctccctccaaggcagcaaagcagaatcgggagcagtggagcagaaatgtgcaagcaccctgatctcactcccagctctgaccaaatacagaattttagagaacatctgaagacatcagactgcactgcgtatacatgttgaattcttcatttttgccatctttaactgtcatcactggggcagggaagtcctgttccagaagtaccaggctgtagatttgataagctagatgcagtagaccgaaaccatccaaaacctgtttagcttcttcctccattggagtttattgggacaaacaggagagccagccattgtctccagtacttgcctcattctcatcatccaaactgaacatttgtatcccaagcagaaataaagagaatatgttctttttaaaaaaaaaaaaa

SEQ ID NO: 127 - DNA, 2187 bp, Homo sapiens
  CDS (207)..(1913)
cccacgcgtccgggcttccggttggggtggcagggtggtggatctgtcggtcccgttttcccgtcgcacgtggtggccactgttggcttctgaatggtttgcaaggcggatatccacgccaaggcctttggatcggccgtgggtacatccgtctgagccgttcctttccatcgcagagcggcggcctccggcggcgctctccagtcatggactaccggcggcttctcatgagccgggtggtccccgggcaattcgacgacgcggactcctctgacagtgaaaacagagacttgaagacagtcaaagagaaggatgacattctgtttgaagaccttcaagacaatgtgaatgagaatggtgaaggtgaaatagaagatgaggaggaggagggttatgatgatgatgatgatgactgggactgggatgaaggagttggaaaactcgccaagggttatgtctggaatggaggaagcaacccacaggcaaatcgacagacctccgacagcagttcagccaaaatgtctactccagcagacaaggtcttacggaaatttgagaataaaattaatttagataagctaaatgttactgattccgtcataaataaagtcaccgaaaagtctagacaaaaggaagcagatatgtatcgcatcaaagataaggcagacagagcaactgtagaacaggtgttggatcccagaacaagaatgattttattcaagatgttgactagaggaatcataacagagataaatggctgcattagcacaggaaaagaagctaatgtataccatgctagcacagcaaatggagagagcagagcaatcaaaatttataaaacttctattttggtgttcaaagatcgggataaatatgtaagtggagaattcagatttcgtcatggctattgtaaaggaaaccctaggaaaatggtgaaaacttgggcagaaaaagaaatgaggaacttaatcaggctaaacacagcagagataccatgtccagaaccaataatgctaagaagtcatgttcttgtcatgagtttcatcggtaaagatgacatgcctgcaccactcttgaaaaatgtccagttatcagaatccaaggctcgggagttgtacctgcaggtcattcagtacatgagaagaatgtatcaggatgccagacttgtccatgcagatctcagtgaatttaacatgctgtaccacggtggaggcgtgtatatcattgacgtgtctcagtccgtggagcacgaccacccacatgccttggagttcttgagaaaggattgcgccaacgtcaatgatttctttatgaggcacagtgttgctgtcatgactgtgcgggagctctttgaatttgtcacagatccatccattacacatgagaacatggatgcttatctctcaaaggccatggaaatagcatctcaaaggaccaaggaagaacggtctagccaagatcatgtggatgaagaggtgtttaagcgagcatatattcctagaaccttgaatgaagtgaaaaattatgagagggatatggacataattatgaaattgaaggaagaggacatggccatgaatgcccaacaagataatattctataccagactgttacaggattgaagaaagatttgtcaggagttcagaaggtccctgcactcctagaaaatcaagtggaggaaaggacttgttctgattcagaagatattggaagctctgagtgctctgacacagactctgaagagcagggagaccatgcccgccccaagaaacacaccacggaccctgacattgataaaaaagaaagaaaaaagatggtcaaggaagcccagagagagaaaagaaaaaacaaaattcctaaacatgtgaaaaaaagaaaggagaagacagccaagacgaaaaaaggcaaatagaatgagaaccatattatgtacagtcattttcctcagttccttttctcgcctgaactcttaagctgcatctggaagatggcttattggttttaaccagattgtcatcgtggcactgtctgtgaagacggattcaaatgttttcatgtaactatgtaaaaagctctaagctctagagtctagatccagtcactgactctgtctggtgttgacagaggatttatttaagctattattttaataaagaactttgtacatttttaaaaaaaaaaaaaaa

SEQ ID NO: 128 - DNA, 2261 bp, Homo sapiens
  CDS (199)..(2169)
aggaaggacgcgtgcagaggaccgcagaggggtggccgtggctgagaggagacagcgccgcagcactgagggtttgggcttgcaggcgctgcaggagacgcccaggcggagtcttgtctcgcagccagctctgagcgggaggcctgagcgggaagcattggcgtccgagcgacttctaggagcctggggttcggcgctatggaggagctcgatggcgagccaacagtcactttgattccaggcgtgaattccaagaagaaccaaatgtattttgactggggtccaggggagatgctggtatgtgaaacctccttcaacaaaaaagaaaaatcagagatggtgccaagttgcccctttatctatatcatccgtaaggatgtagatgtttactctcaaatcttgagaaaactcttcaatgaatcccatggaatctttctgggcctccagagaattgacgaagagttgactggaaaatccagaaaatctcaattggttcgagtgagtaaaaactaccgatcagtcatcagagcatgtatggaggaaatgcaccaggttgcaattgctgctaaagatccagccaatggccgccagttcagcagccaggtctccattttgtcagcaatggagctcatctggaacctgtgtgagattctttttattgaagtggccccagctggccctctcctcctccatctccttgactgggtccggctccatgtgtgcgaggtggacagtttgtcggcagatgttctgggcagtgagaatccaagcaaacatgacagcttctggaacttggtgaccatcttggtgctgcagggccggctggatgaggcccgacagatgctctccaaggaagccgatgccagccccgcctctgcaggcatatgccgaatcatgggggacctgatgaggacaatgcccattcttagtcctgggaacacccagacactgacagagctggagctgaagtggcagcactggcacgaggaatgtgagcggtacctccaggacagcacattcgccaccagccctcacctggagtctctcttgaagattatgctgggagacgaagctgccttgttagagcagaaggaacttctgagtaattggtatcatttcctagtgactcggctcttgtactccaatcccacagtaaaacccattgatctgcactactatgcccagtccagcctggacctgtttctgggaggtgagagcagcccagaacccctggacaacatcttgttggcagcctttgagtttgacatccatcaagtaatcaaagagtgcagcatcgccctgagcaactggtggtttgtggcccacctgacagacctgctggaccactgcaagctcctccagtcacacaacctctatttcggttccaacatgagagagttcctcctgctggagtacgcctcgggactgtttgctcatcccagcctgtggcagctgggggtcgattactttgattactgccccgagctgggccgagtctccctggagctgcacattgagcggatacctctgaacaccgagcagaaagccctgaaggtgctgcggatctgtgagcagcggcagatgactgaacaagttcgcagcatttgtaagatcttagccatgaaagccgtccgcaacaatcgcctgggttctgccctctcttggagcatccgtgctaaggatgccgcctttgccacgctcgtgtcagacaggttcctcagggattactgtgagcgaggctgcttttctgatttggatctcattgacaacctggggccagccatgatgctcagtgaccgactgacattcctgggaaagtatcgcgagttccaccgtatgtacggggagaagcgttttgccgacgcagcttctctccttctgtccttgatgacgtctcggattgcccctcggtctttctggatgactctgctgacagatgccttgccccttttggaacagaaacaggtgattttctcagcagaacagacttatgagttgatgcggtgtctggaggacttgacgtcaagaagacctgtgcatggagaatctgataccgagcagctccaggatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagattttttaaaagaataaatgttgttttgcaaatgtaaaaaaaaaaaaaaa

SEQ ID NO: 129 - DNA, 4758 bp, Homo sapiens
  CDS (167)..(4381)
ctagctcagaaaccgctgcagatgacatcgcaagctcggcacgaggtctctgcggggcaagatggcggcgcccagacaggcctggagcacggatgaataagagggaacccccacacggagacactgctggagagagtcgtactggggaggcagctggagcagcaagatgctgtcgagaccgaagccaggggagtccgaggtggacctgctgcacttccagagtcagtttctcgcagctggtgcagccccagcagtgcagttggtgaagaaaggaaataggggcggtggtgatgccaactcagaccggcctccgctccaggaccatcgggatgtggtgatgttggacaatctcccagatttgcccccagctttggtcccttctcctccaaagagagccaggcccagccctggccactgcctgcctgaggatgaggacccagaagagaggctgaggaggcatgatcagcacatcactgctgtcttgactaagattattgaacgagatacaagttcagtggccgtgaatctgcctgtgcccagtggtgttgctttccctgctgtgttccttcgctcgcgggacacacaggggaaatcagcaacatctggtaagagaagcatctttgcccaggaaattgcggcaaggaggatagctgaagccaagggcccatcagttggggaagttgtgcccaacgtgggcccaccagagggtgccgtgacctgtgagacacccactcctaggaaccagggctgccagcttcctgggagcagccacagctttcagggacccaatctggtcacagggaaggggctcagggatcaagaagctgagcaggaagcccagactatccatgaagagaacatagcaagactgcaggccatggctcctgaggagatcctgcaggaacagcagcggttgctggcccagcttgaccccagcttggttgctttcttgagatctcacagccacacgcaagagcaaacaggagagacagcctctgaggagcagaggccaggaggaccctctgctaatgtcaccaaggaggaacccctcatgtcagcttttgccagtgagcccaggaagagagacaagctggagccagaagccccagctctggcattgcccgtgacccctcagaaagaatggctgcacatggacactgtcgagctggagaagctccactggacccaggacttgccccctgtccggcggcagcagacacaggaggtgaggagggccacctggcctacaaggggtggaggatgcaggctcggttcagtcttcagggagatactactggcccctgacgtggacctgcccacccacctgggtctgcaccaccatggagaggaggcagagagagcggggtattccctacaggagctgttccacctgacccgcagccaggtttcccagcagagagcactggcactgcatgtgttagcccaggtcatcagcagggcccaggctggtgagtttggggaccggctagcaggcagtgtcttaagcctccttttggatgctggtttcctcttcctactgcgcttctccttggatgacagagtggatggggtcattgcaaccgccatccgtgctcttcgggctctgctggtggctcctggagatgaggagctcctcgacagcaccttctcttggtaccatggagctttgacgttccctctgatgcccagccaggaggacaaggaggatgaggacaaggatgaagaatgcccagcaggaaaagcaaaaaggaaaagccctgaagaagaaagccggcctccacctgacctggcccgacatgatgtcatcaaggggctcctggctaccagcctgctgcctcggctgcgctacgtgctggaggtgacatacccaggacctgcggtggtccttgacatcctggctgtgctcatccgcctggcccggcattccctggaatcagccacaagggtcctggagtgccctcggctgatagagactatagttcgagagttcttgcccaccagttggtctcctgtgggggcagggcctacccctagtctatacaaagtaccctgtgctactgccatgaaactacttcgtgtcctggcctcagctgggaggaatattgctgcccggctgttgagcagctttgatctccggagccgcctgtgccgcatcatagctgaggctccccaagaactggccttgcccccagaggaagctgagatgctgagcaccgaggccctccgtctgtgggctgtggctgcctcctatggccagggcggttacctttacagggagctctacccagtgctgatgcgggccttgcaggtggtgccgcgggagctcagcacccacccacctcaacccctgtccatgcagcggatagcctcactgctcactctcctcacccagctaaccctggcagccggcagtacccctgctgaaaccatcagtgattctgctgaggccagcctctcggccaccccttccttagtcacttggacacaggtgtctgggctccagcctcttgttgagccgtgtctaaggcagaccttgaagttgctgtccagacctgagatgtggagagccgtgggcccagtgcccgttgcctgcctgttgttcctgggagcctactaccaggcctggagccagcaaccaagctcatgcccggaggattggctccaggacatggagcgcctgtcagaggagctgctgctgccactgctgagtcagcccacactgggcagcctgtgggattcccttaggcactgctcccttctctgcaacccgctgtcctgtgtgccagcccttgaagctccccccagcctcgtgtcactgggctgctcgggaggctgcccccgtctcagtctggctggctcagcctcacccttcccattcctcactgccctcctctctcttcttaataccctggcccagatccacaaggggctgtgtggccagctggctgccatattggctgccccgggactccagaattacttcctccagtgtgtggctcctggggctgccccacacctcacacctttctctgcatgggccctgcgccatgagtaccacctgcagtacctggcactcgctctggcccagaaagcggcagcgctgcagccactgccagccacccatgctgccctctatcatggtatggccttggccctgctgagccggctgctgcccggaagtgagtacctcacccatgagctgctgctgagctgtgtattccggctggagttcctcccggaaagaacatcagggggtccagaggcagccgacttctctgaccagctgtcgttaggaagcagcagggtccctcggtgtgggcaagggactctgctggctcaggcctgccaggacctccccagcatccgcaactgctacctgactcattgctcgccagcccgagccagtctgctggcctcccaggctctgcaccgaggggagctacagcgagtcccaaccctgctactgcccatgcctacggagccgctgctgcccaccgactggcccttcctgccactgattcgcctctaccaccgggcttcagacaccccctcgggactctctcccacagacaccatgggcacagccatgcgggtcctgcagtgggtgctagttttggagagctggcgcccccaggctctctgggctgtgccccctgctgcccgcctggcacggctcatgtgtgtgttcctggtggacagtgagctgttccgggagtccccagtacagcatctggtggcagccctcctcgcccagctctgtcagcctcaagtcttgccaaacctcaacctggactgccgactccctggcctgacgtctttccctgacctctatgccaacttcctggatcattttgaggctgtctcttttggggaccacctctttggggccctggtcctcctgcccctgcagcgtcggttcagtgtcaccttgcgccttgccctctttggggaacacgtgggagccttgcgagctctgagcctgcctctgacccagttgcctgtgtccctggagtgttacacagtgcctcctgaagacaacctggccctccttcagctctacttccggaccctggttactggtgcgctccgcccacgttggtgccccgtgctctatgctgtggctgtggctcatgtcaatagcttcatcttctctcaggacccacagagctcagatgaggtcaaagctgcccgcaggagtatgctgcagaaaacatggctgctggcagatgagggtctccggcagcacctcctgcactataagcttcccaattccacgctcccagagggctttgagctctattctcagttgccccctctgcgtcagcactacctccagagactgacttcaacagtgctccaaaatggggtatcagagacctaggatagttgatatagatggaaagatgggtacgttgtcctgtatccagcctttcaacagatgtctggccagacgaagaacattgtgtcctaatggtaggcaggagaccaaggagcagaaggcttgccttcctgggagcaggttgtttgagctgttttagagcagtgagccctaccattacatcctgatatctggggcttctgaaggtctgtgctgggagtgaagagtggcttagctatttacccgctctttggggacagggcaaactaaatgcatcccttcttacctaactcccaacccctgccctgggctgaggcatatgaatgctatagttgtgcattaaaataaatgttttttatctcctggaaaaaaaaaaaaaa

SEQ ID NO: 130 - DNA, 3718 bp, Homo sapiens
  CDS (331)..(1437)
aaaaggagacctagccttattggtgagtccttcaactgttatcctccaaactgagggtgacctggagttgagctatattttccctggaaaataggttggggtcagagtcaacatcagagcagagatatgcccattttggcagatgtcatataggtttaggtttgccagagaaaatacaggatgcctacttatgtcccaaatactgcatggcccatacttattctaaaaaagtatttgctttatttaaatctggaatttacatttaactaggtgtcctgtattttagtttcgaaatctggcatccaggccctttgtaggagcattcaaccaatggcgttgtctccacaaacatttaagcctcttactagaaggaacattaacaagggtcgatttcaggaggacacagttacaatgggaagcccaaagagtgggtctcaaggctggctgagtagctggctgcccacgtggcgccccacttccatgtctcagctgaagaatgtggaagccaggatcctccagtgtctccagaataagttcctggccagatatgtatccctcccaaaccagaataagatctggacggtgactgtgagccccgagcaaaacgaccgcacccccttggtgatggtgcatggttttgggggcggcgtgggtctctggatcctcaacatggactcactgagtgcccgccgcacactgcacaccttcgatctgcttggcttcgggcgaagctcaaggccagcattcccaagggacccggagggggctgaggatgagtttgtgacatcgatagagacatggcgggagaccatggggatccccagcatgatcctcctggggcacagtttgggaggattcctggccacttcttactcaatcaagtaccctgatagagttaaacacctcatcctggtggacccatggggctttcccctccgaccaactaaccccagtgagatccgtgcacccccagcctgggtcaaagccgtggcatctgtcctaggacgttccaatccattggctgttcttcgagtagctgggccctgggggcctggtctggtgcagcgattccggccggacttcaaacgcaagtttgcagacttctttgaagatgataccatatcagagtatatttaccactgcaacgcacagaatcccagtggtgagacagcattcaaagccatgatggagtcctttggctgggcccggcgccctatgctggagcgaattcacttgattcgaaaagatgtgcctatcactatgatctacgggtccgacacctggatagataccagtacgggaaaaaaggtgaagatgcagcggccggattcctatgtccgagacatggagattaagggtgcctcccaccatgtctatgctgaccagccacacatcttcaatgctgtggtggaggagatctgcgactcagttgattgagctgctctctgaagaggaagaggagaaagccagagagtcactcttacctccctgtctgcttactcacccactctgtcctttcctcaccaactaacatgtgccagccaggcagagtcttgtgctgttcccagaacaggacgacagtgaaaagaacactcttgaccctacactgaaggctgaaggcagaagccacaagaggccttgagtgccacccccagggaagaacataaagggttgcacaatgccacccatccactccttgccaagtgttacccagatggtggaggatgtgaagggattgcaccaagccacattcactctctctgtggcctttcttcctctgggcaaagaagggcttccagtggcctttcctcactctgtagtgtttgtggggataggttccatgcaagaacaccttcctcctccatcccccacttcaccccatcccataccagttccatccagggtctgcttaactgccaagagcaggtcctggagttcccttcacctgcagagtccttttcatgacctaggaggtcttattcaaagccctcattgacagaggaggaaacaggccaaggcaggacatggctggaccatggtgatacagctctgtgtgattcaagttctggcagagcttgtaaggctagagcccaggtctgccgacaccctgtgcttgttgcacacttgatttgctaaggctggagacaggcaccattgccatggggctggtcctagtcactggccgaggataagcccgtccctgtcccacattctagccccactatgcgggggtgctgttgtcctgcctgtgtctcatccccggctgcctaagctagggacactcaagtgcttccttccttgccccatcttcctcccaactggaggcctctgagcctcccctgtgccttgggccctgaagccccatatgtagtatagagcaaaggtggctcctggtgaagagagggtggaaaggcccttcagccccagggccatgtctgggttctccatgcccatcagtctctgcagtttctctacctgcccccagagctgaggccatctgcaagcccctgcccatggcccaatggggagcctccagccacaagttccctgtccttatcagccactgggtggttcccactgcatgaccctctatccctgccatctgtccccatggtttccagctcaatccacccctgacccatctgtcagctttttcccagggagccgtttcaggggttctgggcagtaggctgggcctggcctcagaacctggtggctcctgcctgctccttcacttttgtaaaaccatccccttcaccagaatggtattaactcctggtgctttgtactactggtccagctgccctgggctccttttctatattaataaagaaacgagtaaaaattaccggtggggatgatgtttaaaattgctctgatcactggtggtgctgaattcgcaacagcctgtgtgatgcctgagagaagggagtcctgagggttgcctgcctacccacgactccttctccttttagtgtggcgtttgcccgctagacccagcccagagtccaggtcagcacaggccctctcagccaaccactcatgacaaatgaggagtcgagatccacagtgtggatggggcaagccccagttcacagtagagaggtggagcttagtacttcctgctgcccattagacaccctttcttcctaagttcaagggaagcccacacatgtactgctccctgcatcctgctctaacttcctctcatcctctggatctcagctcaaatattccttatgcagagatgccttcccctgattccctaaactagactcggacccctctgttctgcatctctgtggcatatcatctgccccttttgtaaaacttataaacttgtggttacttgtttagcgtctctttcctccccagaccataagcaacataaagacaaagggtacatctagcacatagttcgtgttcaataaatgtttgttttcatcatgccacgggaagtgagatatacccagtattcaaaaaagtgttcaaatcattactaacagtgtttgctctgtgctggctgagtccagctgggcccagaattccacggttctaaatggcgcatattccatgtgcataggctgattgaaaatgtattaaacctaaattttaaaaaaaaaagcacatgatactacacatgtcatgatgaatgaatagacagaactcctcctgaatataattacaaagttctgatccatctcaaaaaaaaaaaaaa

SEQ ID NO: 131 - DNA, 3177 bp, Homo sapiens
  CDS (110)..(2515)
ccacgatttcgtggagacggagatcgagcgctgccgcttcgagtgccagtgggagcggatccctgagctcgtcaagcagctgtcggccaagctcatcgccaacgatgacatggcagagcttctcctcggggagtcgaagctggagcagtacctgaaggaacaccccctgaggcagggggccagtccccgaggccccaagccccagctgactgaggtccgcaagcatctgaccgccgccctggaccgagggaaccttaagtcagaattcctacaagaatccaatctgatcatggccaagttgaattatgtggaaggtgattataaagaagctctgaacatttacgcccgggtgggcctggacgatctgccactgacagctgtcccgccctacaggctgcgggtgatcgcagaagcctacgctaccaaaggactttgtttggagaagctgcctatttcttcttctaccagtaatctccatgtggaccgggaacaggatgtcatcacctgttatgagaaagcaggggacatcgcactcctgtatctccaagagatagaaagggtaatactttctaatattcaaaacagaagccctaagcctggccctgctccccacgatcaagaactaggttttttcctagaaacaggacttcagagagcccatgtcctctatttcaaaaatgggaacttgacaagaggagtcggaagatttagagagcttctcagagcagttgaaacaagaacgactcaaaacctgcgaatgacaatagccaggcagctggcagagatcttgttgcggggtatgtgtgagcagagctactggaaccctctggaggatccaccgtgccagtcacctctggacgatcctctccgcaaaggagcaaacacaaaaacctacactctcactcggagagcccgtgtctactcaggagagaacattttttgtcctcaagaaaatacggaagaagccctgttgttattgctgattagtgaatcaatggccaaccgggacgctgtgctgagcaggatacctgaacacaagagtgaccgcctcatcagtctgcagagtgcatctgtggtctatgacttactcaccattgctcttggaagaagaggccagtatgagatgctgtcagagtgcctagaaagagccatgaagtttgcctttgaggaattccacctgtggtaccagtttgctctgtccctgatggctgctggaaaatctgcccgtgccgtgaaggtgctgaaagagtgtatccgcctgaagccggacgatgccaccatccctctcctcgctgccaagctctgcatgggctccctgcactggttggaagaggctgaaaagtttgccaaaactgtcgttgatgtgggagagaaaacgtcagagttcaaggccaaaggctacttagctctggggctcacgtacagtctgcaggccactgacgcttctttgcgagggatgcaggaggtcctacagagaaaggcgcttcttgcatttcagagggcccacagcctgtcacccacagatcaccaagcagctttctacctggctctgcagcttgccatctccagacagatcccagaggctctggggtatgtccgccaagctcttcagcttcaaggtgacgatgccaactccctgcacctccttgccctcctgctgtcagcacagaagcattaccatgacgctctgaacatcatcgacatggccctgagtgaatacccagaaaatttcatactactgttttccaaagtgaagttgcagtcactctgccgaggcccggacgaggcactgctgacttgtaagcacatgctgcagatatggaaatcctgctacaacctcaccaaccccagtgattctggacgtgggagcagcctcttagatagaaccattgctgacagacgacagcttaatacaattactttgccagacttcagcgatcccgagacaggctccgtccatgccacatcggtagcagcctcaagagtggagcaggcactgtcggaagtggcttcgtctctgcagagcagtgcccctaagcagggcccgctgcacccctggatgacgctggcacagatctggctccatgcagctgaagtctatatcggcatcgggaagcctgcagaagccacagcctgtacccaagaagctgccaacctcttcccaatgtcccacaatgtcctctacatgcgcggccagattgctgagctccggggaagcatggacgaggcgcggcggtggtatgaagaggccttagccatcagccccacccacgtgaagagcatgcagcgactggccctgatccttcaccagctaggccgctacagtctggcggagaagatcctccgggacgcggtgcaggtgaactcgacagcccacgaggtctggaacgggctgggcgaggtcctccaagctcagggcaacgatgcggcggctacggagtgcttcctgacagccttggagctggaggccagcagccccgccgtgcccttcaccatcatcccccgcgtgctctgagcaggcgcctgccagcctcacctgccgctcaggcctcagaggcctgccgggcaccagggcttgtgccatcgccccaaggggatgaatctgccgcactgaggccagggacgagtgttcagtgggccacagtgaaccaaccaaaccaaccccgaatcatcgctctcgccatgtgcgtttctcttgttttttttgccagcccaatggtagtttctgaacctattgacattgttcaaaatggatcatgtgccatattttgttagttgacatctgagttttcagtaaaatgattatggaattaatcagcaaatgtagaagaatatattcaaagttaaaattcagtggcagcacagattatttttatcagagctgtaaagaaaacaactgtccttttctccccaccacccctcctgccccactttggcccagaaaccaaatgtgaacttcctgtctcccacctcagcactagtccatgccaggacaccagctgacaatttcttggttttactgtcaataattgtaccatgtgatcaattactgtcctcacttaaaacaaagcctgagtccgagaatatttatattttaccaatatatgcctgttacaagagaaggaaatatgagttatttaagcttaacttttttatgtgaattcagagtttatttaa

SEQ ID NO: 132 - DNA, 1019 bp, Homo sapiens
  CDS (519)..(740)
tcgcgatctagaactagattcaacctaattttcagtaagaagtgattaaaataatgacatgctaaaaggcaaatttcaagggaagaaatgtaaaagaattttacaaatgctttccaagtgatgaatatgctcagttaatttcatatgctcctggattgatagcagtatttggcaatacctatctgtatgagaagacatttttaaagatgaaatgtgtaaaatcttattaccattagtattaatggttaatgatggttaatgataaccattaataggcaatcatttacaactgattttgatcacagggaacacttacttagaaccctgattagaggcaatgttattctcaccaaaaaaggcattacaaaaaattgggctatattttgaattttgtcaattaaaaaagcgtgggagcagtgtgaaggagaagaggcaagaacgacccctggaccgaccaaagcccgcgcgctgctgcgtcccacacccggtgcccacatcccgccgccgccgccgccgccatgcccaagagaaagactgaaggggatgctaaaggagataaagccaaggtgaaggatgaatcacagagaagatctgcgaggttgtctgctaaacctgctcctccaaagccagagcccaagcctaaaaaggcccctgcaaagaagggagagaaggtacccaaagggaaaaagagaaaagctgatgctggcaaggagcgggaaggtgctggagatcccaagtgaagtgtgtgcattttttataactgtacttctggtgactgtacagtttgaaatattctttatcaagttttataaaaatgcagaattttgttttactttttttaagctatgttgttagcacacagaacacttcattgttgtttttgggggaaggggtatgtgtcactaatagaatatctctgaagctggattgatacggggaaaacatctttcccttctagttttgagagacttcctcttggctcccaggaggagggatttcctgactttgacacacatggc

SEQ ID NO: 133 - DNA, 2623 bp, Homo sapiens
  CDS (406)..(1965)
  misc_feature (1)...(2623): n = a,t,c or g
tataagatttaataggtcacttaaggaattggcctcaagccaagattcggcacatgagttccccggccgggttccaccttgtcaggggggtctttaagcctcagccaaactcgggcttcccatggaagccagctgtgccccagagagccaggagaagttgagtgggctgatggccccggtgccgcccggggccctgagcccatcccgctcctagcgctgcctaaaggccacgggcgccggcgccccaanccngggcgcgccgcctccgtccgcccttccccgggggcttcgcccgacctgccccccgcccgtttgccagcgctcaggcaggagctctggactgggcgcgccgccgccctggagtgagggaagcccagtggaagggggtcccgggagccggctgcgatggacgccgtcttggaacccttcccggccgacaggctgttccccggatccagcttcctggacttgggggatctgaacgagtcggacttcctcaacaatgcgcactttcctgagcacctggaccactttacggagaacatggaggacttctccaatgacctgttcagcagcttctttgatgaccctgtgctggatgagaagagccctctattggacatggaactggactcccctacgccaggcatccaggcggagcacagctactccctgagcggcgactcagcgccccagagcccccttgtgcccatcaagatggaggacaccacccaagatgcagagcatggagcatgggcgctgggacacaaactgtgctccatcatggtgaagcaggagcagagcccggagctgcccgtggaccctctggctgccccctcggccatggctgccgcggccaccatggccaccaccccgctgctgggcctcagccccttgtccaggctgcccatcccccaccaggccccgggagagatgactcagctgccagtgatcaaagcagagcctctggaggtgaaccagttcctcaaagtgacaccggaggacctggtgcagatgcctccgacgccccccagcagccatggcagtgacagcgacggctcccagagtccccgctctctgcccccctccagccctgtcaggcccatggcgcgctcctccacggccatctccacctccccactcctcactgcccctcacaaattacaggggacatcagggccactgctcctgacagaggaggagaagcggaccctgattgctgagggctaccccatccccacaaaactccccctcaccaaagccgaggagaaggccttgaagagagtccggaggaaaatcaagaacaagatctcagcccaggagagccgtcgtaagaagaaggagtatgtggagtgtctagaaaagaaggtggagacatttacatctgagaacaatgaactgtggaagaaggtggagaccctggagaatgccaacaggaccctgctccagcagctgcagaaactccagactctggtcaccaacaagatctccagaccttacaagatggccgccacccagactgggacctgcctcatggtggcagccttgtgctttgttctggtgctgggctccctcgtgccctgccttcccgagttctcctccggctcccagactgtgaaggaagaccccctggccacagacggcgtctacacggccagccagatgccctcccgaagcctcctattctacgatgacggggcaggcttatgggaagatggccgcagcaccctgctgcccatggagcccccagatggctgggaaatcaaccccggggggccggcagagcagcggccccgggaccacctgcagcatgatcacctggacagcacccacgagaccaccaagtacctgagtgaggcctggcctaaagacggtggaaacggcaccagccccgacttctcccactccaaggagtggttccacgacagggatctgggccccaacaccaccatcaaactctcctaggccatgccaagacccaggacataggacggacccctggtacccagaagaggagttcttgctcactaacccggatccgcctcgtgcccctgcctcctggagcttcccattccaggagaaaaggctccacttcccagcccttccttgcccctgacatttggactcttcccttgggccgaccactctgttctcattctccttcccaccaacatccatccgtccttctcagacaaaccactcactgggtaccccacctcctctctcatatgcccaacacgaccactgcctccctgcccccacacctgcacccaaacagacacatcaacgcaccccactcacagacaccccttaccccacccccactgtacagagaccaagaacagaaattgtttgtaaataatgaaccttattttttattattgccaatcccctaagatattgtattttacaaatctccctcttcccttcgcccctcccttgttttatattttatgaagttagtgcgggctttgctgctccctggcccaggaaagagggactacctgaccctcacctggcacccccctgctgctgcccaagccgctgggcctttttaattgccaaactgctctcttcatcagctcagcacatgctttaagaaagcaaaaccaaaaaaaaaaaa

SEQ ID NO: 134 - DNA, 5559 bp, Homo sapiens
  CDS (1)..(2799)
atggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacgtaagtctgaacgcttacaccgtaaaaaacttaatgggagagaagcttttgttcatgtagttaccctagaagatatgagagagattgagaaaaatccccctgcccaaggaaaaaagggattaaagatgcctgtgccaggtaatcctgcagttccaggaatgcccaatgcgggactgcccggtgtgggactgcccagtgcaggacttcccggtgcaggcctgcccagcacaggactgcctggttcagcaataaccagtgcaggactgcctggtgcgggaatgcccagtgcaggaatacctagtgcaggaggtgaagagcatgccttcctgactgtaggatcaaaggaagccaataatgggcctccatttaactttcctggtaattttggtggatcaaatgcctttgggccaccaatccctcctccaggattaggaggcggggcctttggtgatgctaggcctggtatgccttcagttggaaacagtggtttgcctggtctaggactggatgttccgggttttggaggtggaccaaacaatttaagtgggccatcgggatttggagggggccctcagaattttggaaatggccctggtagcttaggcggtcccccggggtttggaagtggccctcctggtcttggaagtgcccctgggcatttgggtgggccaccagcttttgggcctggccccggccccggccccggccctggcccaatccatattggtggtccccctggctttgcatctagttctggaaaaccaggaccgacagtaattaaagtgcaaaacatgccctttactgtgtctattgatgagattttagatttcttttatggctatcaagtaatcccaggctcagtgtgtttaaaatacaatgaaaaaggtatgcccacaggtgaagccatggtggcctttgagtctcgggatgaagccacagctgctgtcattgacttaaatgacaggcctataggttcaagaaaagtaaaacttgtattagggtagccattcacatcattttttatagggtagatcttcatattgctgtgattaatgcatccagattgttttcctagtatttccaggttagaacctgtggattgtttcaattgcatatagcttggtttccataacatagagcattggttgactgtttacagaagactcactcaccaggataaacattgctgtatgttacagtaaagctatctggagagaacacataaatgattttggcataccattagagaaaccatttgtaaaactcaaatgaccacataaagcttatcaaggagtctagattggttttgttttataccatatgggatgaagaaaatagaaatgtcagtagaactcattgagggtgctcttgccagctgctgaaaatagaagttggctactctcagaatttggtttaaagctggacagatttgctttgttatagggtaaagctttgtctaaagtcctcattttcttttaaaattgaataaaatttctgtatacagattcattgtatgtacctttattgcttcttaagggtccttgctgtatagacagtcctgcttcagaagttgctgctttgtttgtctaattgactcatttgtaaatgagcagaactgttttgttggtttttttccctaaatataaaagtccacacttcgtttgtgctataacctcaaactttgatttctaatgtcacacttaaaactgtgtggaataagacttttgccataaaaataaactatggagtcctttatctaccagagcctttttggtttgaccgccacgatttaggttagtcagtttaaaaattgttcatgttgtttggatggtatcgaaaaccagaaaccacttttaataatgtgtttaagatacttgatttgaagtccttttcatatggactaattgtagtatcaatttcctcctgtcccgattatgtgaaattttggcctttaaacaaagaggggcccattcataagaaagtgttatatctaggtttttaaaactgaagttgaaattatctttgttagcagtagtagtatagaataaaagatccgtatgctggttcgtagattgatacgtgttagtcctgttatttggaggctttttggcatagttgttcgatcaggagcctgtttactaaaagtcttcatacagagtacaagtgcagccgtccagaggagaaaattgagattcttgaccctttcatactcttttctttggtattcaggacactaaggcaggaggaccacatgagttctggttggtaagtgtccttgtcatgaaaacacttgccttacaaggctctaattatgatttccctagtcagtgctctgaagatgtgtcacattatattataaacaatacggaaggggagataggtgagatgatatgaaaaacaaattttctcactgtcataaaaggctctaattatggttactttccttgtgatgaaaaacttggccttacagggctctagttatggttactttccctagtcaatgctctgaaaatgtgtcacattataaacaatacagaaggagagatagatgagagatcatgaaaaccaaattttatcttttacatggcccctttgtcttcgtttgaaacatccccaacatttcctacaaatcagcgtagttacaaaggggtcagtcttttaaaataagtatttcctattaaactatatatatatacagtgcctttttggtgttgtgagtcagtggaacactgaaatacagcggttgtgtaatttaagagtggcaacagtttcatttgataagatttgaaaaggctttttatcactacaatcttagaggattgacagtacaggatttttgtttaagagaaggattgtttagactcaagaggtgactatgttgtgggtcttttgataattcatgaatacagatttgctttgaccgatcactagatactgcctcctcaatttcaaaagcaatataacgtttgtatatgctgtttaatttaagttaatgttaagtaatcatttctcattccaaagacaatgcaaaaaacttcagcactgcttgagagttgtatttcagccacagatattttctccattggaaagctattttcattttagaaaaatgggttgtttgaagatgaaagtcttttatcttttttcacaatttattttggttatatgttcgtacattcttattaaatatttcatacactttattgcaactactttgttatttctacatcttagataaatgctgaaaaggaaaacgatttcattgttcatctaattaaataaattaaaagagcggtttgtgtagaaattggagagaactatgttttatatgaatcacaacagtgctcgttgtggactgtaattaaatgctttgccctctggaacttgatttttgtgtatctgagatttattaacagtgctaactgctaaggatactgtttatcttgttctgggcattggagtttcagtttttaaaaaattcttgaaaatgtattctgtgaaactactcatacctctcttcctgcgaattttctcctaagaactaggtttggggtagaaatgaattgacattattttctcatttgctttgtatggtatgaaggatttgtaaagctttgctcaaagttgtgtgcatttgtaaacactatcatgatattttcaattttatgtgtaaattttattgtctgtttttggtgactctgacattaatggaagagaatattttccattagatttaattttttttcctctcaaaaaaaaaaaaa

SEQ ID NO: 135 - DNA, 4058 bp, Homo sapiens
  CDS (454)..(2523)
ggggctcgtcaatatccagggattcccttgcccgagacccttgaccgtgcttcctgggtcctacgccgcaacgtcctctggcagctcgaagaagctgtcggggcttgcaggagagcgggcaaactgaagcctgaaacatggggactcgaggaacatccgggtggaatcgcagactcaccggagcgcagcgcctgggccagggcctgggaccctcgtccgccccgcgctcccctgcaccccttccccacgctgctcccctcttcctaagcggccccccctctcccgggcagcagaagaaggggtgggacccgggcgggctccgggagggggccctggaggaatggatggtggcggaagggcggagcaggggcggggcccgcggagactccacggggcgccccgggcgtgaggcacccactctgggagcacagagagctcaggtagcctgcctagatggcggcgcgcaccctgggccgcggcgtcgggaggctgctgggcagcctgcgagggctctcggggcagcccgcgcggccgccgtgcggggtgagcgcgccgcgcagggcggcctcgggaccctcgggcagcgctcccgcagttgcagcagcagcagcacagccaggctcgtatcccgcgctgagtgcacaggcagcccgggagccggccgccttctgggggcctctggcgcgggacactctcgtgtgggacaccccctaccacaccgtctgggactgcgacttcagcactggcaagatcggctggttcctgggaggccagttaaatgtctctgtcaactgcttggaccagcatgttcggaagtcccccgagagcgttgctttgatctgggagcgcgatgagcctggaacggaagtgaggatcacctacagggaactactggagaccacgtgccgcctggccaacacgctgaagaggcatggagtccaccgtggggaccgtgttgccatctacatgcccgtgtccccattggctgtggcagcaatgctggcctgtgccaggatcggagctgtccacacagtcatctttgctggcttcagtgcagagtccttggctgggaggatcaatgatgccaagtgcaaggtggttatcaccttcaaccaaggactccggggtgggcgcgtggtggagctgaagaaaatagtggatgaggctgtgaagcactgccccaccgtgcagcatgtcctggtggctcacaggacagacaacaaggtccacatgggggatctggacgtcccgctggagcaggaaatggccaaggaggaccctgtttgcgccccagagagcatgggcagtgaggacatgctcttcatgctgtacacctcagggagcaccggaatgcccaagggcatcgtccatacccaggcaggctacctgctctatgccgccctgactcacaagcttgtgtttgaccaccagccaggtgacatctttggctgtgtggccgacatcggttggattacaggacacagctacgtggtgtatgggcctctctgcaatggtgccaccagcgtcctttttgagagcaccccagtttatcccaatgctggtcggtactgggagacagtagagaggttgaagatcaatcagttctatggcgccccaacggctgtccggctgttgctgaaatacggtgatgcctgggtgaagaagtatgatcgctcctccctgcggaccctggggtcagtgggagagcccatcaactgtgaggcctgggagtggcttcacagggtggtgggggacagcaggtgcacgctggtggacacctggtggcagacagaaacaggtggcatctgcatcgcaccacggccctcggaagaaggggcggaaatcctccctgccatggcgatgaggcccttctttggcatcgtccccgtcctcatggatgagaagggcagcgtcgtggagggcagcaacgtctccggggccctgtgcatctcccaggcctggccgggcatggccaggaccatctatggcgaccaccagcgatttgtggacgcctacttcaaggcctacccaggctattacttcactggagacggggcttaccgaactgagggcggctattaccagatcacagggcggatggatgatgtcatcaacatcagtggccaccggctggggaccgcagagattgaggacgccatcgccgaccaccctgcagtaccagaaagtgctgtcattggctacccccacgacatcaaaggagaagctgcctttgccttcattgtggtgaaagatagtgcgggtgactcagatgtggtggtgcaggagctcaagtccatggtggccaccaagatcgccaaatatgctgtgcctgatgagatcctggtggtgaaacgtcttccaaaaaccaggtctgggaaggtcatgcggcggctcctgaggaagatcatcactagtgaggcccaggagctgggagacactaccaccttggaggaccccagcatcatcgcagagatcctgagtgtctaccagaagtgcaaggacaagcaggctgctgctaagtgagctggcaccttgtggggctcttgggatgggcgggcacccaagccctggcttgtccttcccagaaggtacccctgaggttggcgtcttcctacgtcccagaagcagcccccaccccacacatgacccacaccgccctcacgtgaagctgggctgagagccctttctcccatccattggaggtcccaggagtgtcacccatggagaggctatgcgacatggctagggctggttctgccatctgagtttggtttcctggaatgaaaaggcattgccatctccattcctctgccctcttgagccagcacaggaaggtgaggccctgggatagcgcgcctgctcagataacacagagctagttagctagtagcaaccgtgttttctccagatctgtctagatacaaaggtcagaaatcttatttttatacttttatattgtggaagaacagcatgcaacactcacatgtagtgtgtggatttacttgaacatgttctttttaacatgtagttatgaaaatctccttttttgcctctactggtgaggaaacatgaggatcagaggccacatttttaattattgttagtgtatttggaagtctgaattggagatgtttgtacctctgtctaaacagttcccttgagaacttccaagcctccggcatcttttcctggtgagtgtttctcctgtgcttggttgtgtataatggagctaactcctaagcggtggggtgaatgtggccgccttagttctgaagctactccagttatgttctgtttcttcaagctgtgatccagaaagatttttgtgcccccagatgcctcttgataggagaggcaacatactccaaatagttgggttcttcagggaagctattagaaactcaggtgacttgttagagcactaacttggtcagagccaaatcctggcaaacgctgcctgaccttcactctgtggttggggcagtgagaaccactgaggtccaatgatgagacttggaggtctggatccagtctctctttgttttaatgtgacttaggtgctgtcaacattagcaagataatggaaatcacgacgccagtgggtgcttacctccctgctaggcatgcaggggctggcggttggcaggggaaggaggcccagtgagccgggtcccttaggggagggagagtttgtcctctttgccccacagtctacccttcagggccttgtggcagtgccagtgttcggggggtgtctgggccactgagtacccactcggtcgtggttgtgctggcctcttgggtgagtgaacctgtgaagcccaggaggtggtgttggctgcagggtacacaaatactgagtggtggtcttttgttacaggcttagcaacaaagctgtgccctgggcatggggggctgtagtgtagctacagttgtgcgtttgtgaaatggcttagctttccatgttgctgagaggaacctggacatggtcccgggcatctgaatgatctgtaggggagggagttcaaataaagctttattttgttcaaaaaaaaaaa

SEQ ID NO: 136 - DNA, 1227 bp, Homo sapiens
  CDS (9)..(659)
atccccagatgcgaaaagcccagtgggccaggcgagcagcggcgcgcagaagtccctgccccgcggcccggccccggccccgccctactgagggtgcgcagacggcacccgccttttacgacgcgccggaaagcaacggcaagggccgcagccagcaccgggcggagagggctaccatggggaaaatcgcgctgcaactcaaagccacgctggagaacatcaccaacctccggcccgtgggcgaggacttccggtggtacctgaagatgaaatgtggcaactgtggtgagatttcggacaagtggcagtacatccggctgatggacagtgtggcactgaaggggggccgtggcagtgcttccatggtccagaagtgcaagctgtgtgcaagagaaaattccatcgagattttaagcagcaccatcaagccttacaatgctgaagacaatgagaacttcaagacaatagtggagtttgagtgccggggccttgaaccagttgatttccagccgcaggctgggtttgctgctgaaggtgtggagtcagggacagccttcagtgacattaatctgcaggagaaggactggactgactatgatgaaaaggcccaggagtctgtgggaatctatgaggtcacccaccagtttgtgaagtgctgatccctcttccttcccagttgcccttaagaactgagaaaggacaaagtactctaagcagcagagcccacagaggctcgttcctttgacccttgtctcctggtggctatacgaaaccttcacaatctgcatgctggactttattacagcttcccaagccccatcaataaagcccctgttcacgctgcactggtgcatgaaggtgaagtaaggaggcagctactccctccacaaataagaattcgtgcagcagcagttcactccttaggaaaatgaagagtatttttaaggagatggtatctccccagtcaagggcaagtttacagagatgaaaccgcgatcccaccatcactcaatgagccagaagccaatggtgacgtactgttacctgaacttactgaacttgctgttggaaagatctttgtgaggattaggaattaggttaaaagaaattaagaaccatcttcaagcaaaaattaaactttatttctgcttaaacaataaatacacctgagttagttttccaaacctttcctcctgattaaatgcccttaaaacttaaaaaaaaaaa

SEQ ID NO: 137 - DNA, 2474 bp, Homo sapiens
  CDS (110)..(1225)
aaggatccttaattaaattaatcccccccccccccccggtgggaccgctgaccgcgcggctgctccgctctccccgctccaagcgccgatctgggcacccgccaccagcatggacgctcgccgcgtgccgcagaaagatctcagagtaaagaagaacttaaagaaattcagatatgtgaagttgatttccatggaaacctcgtcatcctctgatgacagttgtgacagctttgcttctgataattttgcaaacacgaggctgcagtcagttcgggaaggctgtaggacccgcagccagtgcaggcactctggacctctcagggtggcgatgaagtttccagcgcggagtaccaggggagcaaccaacaaaaaagcagagtcccgccagccctcagagaattctgtgactgattccaactccgattcagaagatgaaagtggaatgaattttttggagaaaagggctttaaatataaagcaaaacaaagcaatgcttgcaaaactcatgtctgaattagaaagcttccctggctcgttccgtggaagacatcccctcccaggctccgactcacaatcaaggagaccgcgaaggcgtacattcccgggtgttgcttccaggagaaaccctgaacggagagctcgtcctcttaccaggtcaaggtcccggatcctcgggtcccttgacgctctacccatggaggaggaggaggaagaggataagtacatgttggtgagaaagaggaagaccgtggatggctacatgaatgaagatgacctgcccagaagccgtcgctccagatcatccgtgacccttccgcatataattcgcccagtggaagaaattacagaggaggagttggagaacgtctgcagcaattctcgagagaagatatataaccgttcactgggctctacttgtcatcaatgccgtcagaagactattgataccaaaacaaactgcagaaacccagactgctggggcgttcgaggccagttctgtggcccctgccttcgaaaccgttatggtgaagaggtcagggatgctctgctggatccgaactggcattgcccgccttgtcgaggaatctgcaactgcagtttctgccggcagcgagatggacggtgtgcgactggggtccttgtgtatttagccaaatatcatggctttgggaatgtgcatgcctacttgaaaagcctgaaacaggaatttgaaatgcaagcataatatctggaaaatttgctgcctgccttctacttctcaaatctttcttgtaaaagtttccaattttttcactgaaacctgagttaaaaatcttgatgatcagcctgtttcataagaaactccaatcaagttaatcttagcagacatgtgtttctggagcatcacagaaggtatattgctagttacactttgccctcctgcagtttcttctctgctcccaacccccatctcatagcatccccctctatttccaatgctcctctccaaccgcttagtttctgaatttcttttaaattacagttttatgaaagcatattttatttacttggtgttgaaatagccctcataaaacctaagcacttggaaacacaataatagtattaactaactagatctattgaatttcagagaagagccttctaacttgtttacacaaaaacgagtatgatttagcattcatactagttgaaatttttaatagaatcaaggcacaaaagtcttaaaaccatgtggaaaaattaggtaattattgcagattgatgtctctcaatcccatgtattgcgcttatgttacaagttgttgtcacagttgagacttaatttctcctaatttcttctgcccgaagggtaagtggtgcgtccagcttacacaatcataattcaaaggttggtgggcaatgtaatacttaattaaaataatgatggaagagctatctggagattatgagtaagctgatttgaattttcagtataaaactttagtataattgtagtttgcaaagtttatttcagttcacatgtaaggtattgcaaataaattcttggacaattttgtatggaaacttgatattaaaaactagtctgtggttctttgcagtttcttgtaaatttataaaccaggcacaaggttcaagtttagattttaagcacttttataacaatgataagtgcctttttggagatgtaacttttagcagtttgttaacctgacatctctgccagtctagtttctgggcaggtttcctgtgtcagtattccccctcctctttgcattaatcaaggtatttggtagaggtggaatctaagtgtttgtatgtccaatttacttgcatatgtaaaccattgctgtgccattcaatgtttgatgcataattggaccttgaatcgataagtgtaaatacagcttttgatctgtaatgcttttatacaaaagtttattttaataataaaatgtttgttctaaaaaaaaaaa

SEQ ID NO: 138 - DNA, 3382 bp, Homo sapiens
  CDS (425)..(2464)
tgccgcaatcctggtggacccggtgccgtggcccaggggccgggccgaggtcccgggggcggtgccttgcgggcccgtcccggggcggtgcctggtgggctggccccgcggttcctcccctctctgcgggcccagtcgccctttggccgggcgagctaatcgtcggctcaatgacgacgaggcccgacccttcccgtccaggacctacagagacaaccgaaggagagcccaaggcggcttctttgctgtcgccgcccccactgaagcaagagctccccggctccactgaaacaccagctcatttaagctttccccaacgaccggccctccgggacgatacctaacaacgaccggcgcccgcatctggaataggctggcgagatacttagtatccgagggctcgggacttggcgccatcgaggtcatggggacccaggatccagggaacatgggaaccggcgtcccagcctcggagcagataagctgtgccaaagaggatccacaagtttattgccctgaagagactggcggcaccaaggatgtgcaggttacagactgtaagagtcccgaagacagccgacccccaaaagagacggactgctgcaatccggaggactctgggcagctgatggtttcctatgagggtaaagctatgggctaccaggtgcctccctttggctggcgcatctgtctggctcatgagtttacagagaagaggaaaccctttcaagctaacaacgtctccctaagcaacatgataaagcatataggcatgggcttgaggtacctgcagtggtggtaccggaagacccatgtggaaaagaagacacctttcatcgacatgatcaattctgtacccctaagacagatttatggttgtcccttgggtggcatcgggggaggcactattacccgtggctggagaggccagttctgtcgttggcagcttaaccctggaatgtatcagcaccggacagtcatcgctgaccaattcacagtgtgcctgcgtcgggaagggcagactgtgtaccagcaagtcctgtccctggagcgcccaagtgtcctccgcagctggaactggggcctgtgtgggtactttgctttctaccatgccctctatccccgagcctggactgtctatcagcttcctggccagaatgtcaccctcacctgccgtcagatcacacccatcttgccccatgactaccaggacagcagcctgcctgtaggagtctttgtgtgggatgtggaaaatgaaggggacgaagctctagatgtgtccatcatgttctccatgcggaatggactgggtggtggagacgatgccccagggggtttgtggaatgagcccttctgtctggagcgtagcggggaaactgtccgggggctgctcctgcatcatccaacccttccaaacccctacacgatggctgtggctgcacgagtcacggcagctaccacggtaacccacatcacagcctttgaccctgacagcacggggcagcaggtgtggcaggatctacttcaggatggacagctggactctcccactggccaaagcacccctacgcagaaaggagtaggcattgctggagctgtgtgtgtttccagcaagttgcgacctcgaggccagtgccgcctggagttttcactggcttgggacatgcccaggatcatgtttggagctaaaggccaagtccactacaggcggtatacaaggttctttggccaggatggagatgcagcacctgccctcagccactatgcactgtgccgatacgcagagtgggaagagaggatctcagcttggcagagcccggtattggatgacagatcactgcctgcctggtacaaatctgcgctgttcaatgaactatacttcctggctgatggaggcacagtgtggctggaagttcttgaggactccctaccagaggagctgggcagaaacatgtgtcacctccgccccaccctacgggactacggtcgatttggctaccttgagggccaggagtaccgcatgtacaacacatatgatgtccacttttatgcttcctttgccctcatcatgctctggcccaaacttgagctcagcctacagtatgacatggctctggccactctcagggaggacctgacacggcgacggtacctgatgagtggggtgatggcacctgtgaaaaggaggaacgtcatcccccatgatattggggacccagatgatgaaccatggctccgcgtcaatgcatatttaatccatgatactgctgattggaaggacctgaacctgaagtttgtgctgcaggtttatcgggactattacctcacgggtgatcaaaacttcctgaaggacatgtggcctgtgtgtctagctgtgatggaatctgaaatgaagttgacaaggaccatgatggactcattgaagatggaggctatgcagaccagacctatgatggatgggtgaccacaggccccagtgcttactgtggagggctgtggctggcagctgtggctgtgatggtccagatggctgctctgtgtggggcacaggacatccaggataagttttcttctatcctcagccggggccaagaagcctatgagagactgctgtggaatggccgctattacaactatgacagcagctctcggcctcagtctcgtagtgttatgtctgaccagtgtgctggacagtggttcctgaaggcctgtggcctaggagaaggagacactgaggtgtttcctacccaacatgtggtccgtgctctccaaactatctttgagctgaacgtccaggcctttgcaggaggggccatgggggctgtgaatgggatgcagccccatggtgtccctgataaatccagtgtgcagtctgatgaagtctgggtgggtgtggtctacgggctggcagctaccatgatccaagagggcctgacttgggagggcttccagacagctgaaggctgctaccgtaccgtgtgggagcgcctgggtctggccttccagaccccagaggcatactgccagcagcgagtgttccgctcactggcctacatgcggccactgagcatatgggccatgcagctagccctgcaacagcagcagcacaaaaaggcctcctggccaaaagtcaaacagggcacaggactaaggacagggcctatgtttggaccaaaggaagccatggcaaacctgagcccagagtgagccgtctgaactgtgggagggaagtgctaacagcccagcctcagcctggcctttcttcttccctcgtgaactcgtgcaacctgaccatcaggcaatatacccttcctttctcacccattgtccagtaatggggtgaggtactagcacatagatatatatcttctactgtctatgg

SEQ ID NO: 139 - DNA, 3881 bp, Homo sapiens
  CDS (66)..(2738)
tcccgggtttacgatttcgtgcccgctctcggcgagcccgagccgtcgccggcccctcggcggagatgagcaggtccgcgacgctgctgctgtgcctgctgggctgccacgtctggaaggcggtgaccaagacgctgcgggagcccggcgccggagcccaagaggtgacgttaaaggtgcacatcagcgacgccagcacccaccagcccgtagcagatgcgctcatcgagatcttcaccaaccaggcctccatagcctctggcacctcggggactgatggcgtcgcctttatcaagttccagtataagctgggcagtcagttgattgtcaccgcctcgaagcatgcctacgtgccaaactctgccccatggaagccaatccggttacctgtattttcctctctgagccttggcctgcttccagaacgctctgccactctaatggtatatgaagatgtcgtccaaatagtatcaggattccaaggtgcccggccacagcctcgcgttcatttccagagaagggctctgaggttgcctgagaacaccagctacagtgacctgaccgcgtttctcacggccgccagctccccttcggaggtggacagttttccttatttgcgaggattagacggaaatggaacaggaaacagcaccaggcatgacctgaccccagtcacagccgtcagcgtccacttgctgagcagtaatggaacgccggtgctggtggatggtcccatctatgtcactgtgcccctggccacgcagagcagcctgaggcacaatgcctatgtcgcggcgtggcggtttgaccagaagctgggaacgtggctgaagagcggtctgggtcttgtgcaccaggaaggcagccagctgacgtggacatacattgccccccagttggggtactgggtggccgccatgtcccctcccatcccaggtcccgttgtaacacaggacattaccacgtatcacacggtgtttcttttggccattttaggaggaatggctttcatacttttggttttgctgtgtctccttttatattattgcaggaggaagtgcttgaaacctcgtcagcaccacagaaaactgcagctccctgcaggactggagagttccaaaagagaccagtccacgtccatgtcacacattaacttgctgttttcacgccgagcgtcagaattccctggcccgctgtccgtcaccagccacggccgccccgaggcccccggcacgaaggaactgatgagtggagtccatttggaaatgatgtctccgggcggcgaaggggacctgcacacccccatgctcaagctctcctacagcacctcccaggaatttagctcccgggaggagctcctctcttgcaaggaagaggataaaagccagatctcctttgataacctcactccaagtgggacgctggggaaagactaccataagtcagtggaggtttttcccttaaaggcaagaaaatctatggaaagagaaggctacgagtcctcgggcaatgatgactacaggggtagttacaacaccgtgctctcacagcctttatttgaaaagcaggacagagaaggtccagcctccacgggaagcaaactcaccattcaggaacatctgtaccccgcgccttcatcacctgagaaagaacagctgctggaccgcagacccactgaatgtatgatgtcgcgatcagtagatcacctcgagagacctacgtccttcccacggcccggccagttaatctgctgcagttctgtcgaccaggtcaatgacagcgtttacaggaaagtactgcctgccttggtcatcccggctcattatatgaaactccccggggaccactcctatgtcagccagcccctcgtcgtcccggctgatcagcagcttgagatagaaagactacaggctgagctgtccaatccccatgccgggatcttcccacacccgtcctcacagatccagccccagcccctgtcttcccaggccatctctcagcagcacctgcaggatgcgggcacccgggagtggagccctcagaacgcatccatgtcggagtctctctccatcccagcttccctgaacgacgcggctttggctcagatgaacagtgaggtgcagctcctgactgaaaaggccctgatggagcttgggggtgggaagccgcttccgcacccccgggcgtggttcgtctccttggatggcaggtccaacgctcacgttagacattcatacattgatctccaaagagctggaaggaacggaagtaatgatgccagtttggactctggcgtagatatgaatgaaccaaaatcagcccggaagggaaggggagatgctttgtctctgcagcagaactacccgcccgtccaagagcaccagcagaaagagcctcgagccccagacagcacggcctacacgcagctcgtgtacctggatgacgtggaacagagtggtagcgaatgtgggaccacggtctgtacccccgaggacagtgccctgcgatgcttgttggaggggtcgagtcggagaagtggtggccagctgcccagcctgcaggaggagacgaccagacggactgcggatgccccctcggagccagcagccagcccccaccagagaagatctgcccacgaggaagaggaagacgatgatgatgatgaccaaggagaagacaagaaaagcccctggcagaaacgggaggagaggcccctgatggcgtttaacattaaatgagctatcgcagacccacctgactgtggaatataaaattgccaaatatcctttctcatggaagcgcgtacccgttcgtggaggaaacggaacggcagcccagccgtgggacggacgtggacgtttactgcattcctgtttgccgtgtaaatgttagaaaggaattaaagttattactcggaataaaggatgactttggcggatgtcgcccctgcaaggaggtggctgaaagtggtgtccagatgtccttccgaggactcggcgtatccgccaccagggacattaagaaaccgcacgtgatgtcgctatgctctaacgatcacctcagttctccctcggattctgggaacagatgaaactttttgcatcgcttgagtcatttttatcacaataatcctactgtgaagctgtcgttgagaacttaggttggcacgtagcgtctcaaggtatgcgttctctcaaaggaaagctatgcatcgctgcttcgttgtctgattttgcttagattttgctttggttaggttgcgttttggggtttgcctttttttgttgtcgcttaaatgcaatttggttgtaaagatttgattcctttgtgttcatctgttccgcttctcagcggtccatctcagcgtctcccttcaggaaccgctgagtgtcctctcttaacatccaagccttttaatgaaatcgtactgaaatctgtatcagctaagagtcctccaatcctggtcccattaactccaagtgcctttttgacagtgacaacagacagtccctcgctttttgttgttgttggttttcttaacccctttaatggaactgcctggattttatacagttattaaaggatgtctcttttgctttaaactgcatgctgccaagtgccatttggggtcagcatcctcgtttcaacacagtgtgatctctagttatcatgtgtaacgtgggttctgtttagcgaagatagactagaggacacgttagagatgcccttccctgctccatccctgtggcaccattatggttttttggctgtttgtatataacggttacgtattaactctggaatcctatgggctcatcttgctcacccaatgtgggagtctggtttgagcaagcgagctgaatgtgactattaaaaaaaaa

SEQ ID NO: 140 - DNA, 1147 bp, Homo sapiens
  CDS (89)..(787)
  misc_feature (1)...(1147): n = a,t,c or g
gcacgagctcgactcttagcttgtcggggacggtaaccgggacccggtgtctgctcctgtcgccttcgcctcctaatccctagccactatgcgtgagtgcatctccatccacgttggccaggctggtgtccagattggcaatgcctgctgggagctctactgcctggaacacggcatccagcccgatggccagatgccaagtgacaagaccattgggggaggagatgactccttcaacaccttcttcagtgagacgggcgctggcaagcacgtgccccgggctgtgtttgtagacttggaacccacagtcattgatgaagttcgcactggcacctaccgccagctcttccaccctgagcagctcatcacaggcaaggaagatgctgccaataactatgcccgagggcactacaccattggcaaggagatcattgaccttgtgttggaccgaattcgcaagctggctgaccagtgcaccggtcttcagggcttcttggttttccacagctttggtgggggaactggttctgggttcacctccctgctcatggaacgtctctcagttgattatggcaagaagtccaagctggagttctccatttacccagcaccccaggtttccacagctgtagttgagccctacaactccatcctcaccacccacaccaccctggagcactctgattgtgccttcatggtagacaatgaggccatctatgacatctgtcgtagaaacctcgatatcgagcgcccaaccctacactacccattgaaccgccttatgtagtccagactagtgtcctccatcactgcctatccctgaggattctgaatcggaagccactgaagtgttcgaccgttcacctaggaatttccatggaccagagcctggatgtcgccgtaacccccgcattccatctatcgccctctggcccacaatagtgcgcccttgttcactcgtcatagctgatgaatatgccttacccactgagatcaaagccttgacctgttaggcgatgaggatcgacgaaaaatggcgtatgcnttgtggacgtcagctcgaacaccagcatcggttgacacattgtggacgccctccgcccaatgggtaaaatcaccattggcgtttgcctagccctgtctgtac

SEQ ID NO: 141 - DNA, 1491 bp, Homo sapiens
  CDS (152)..(1411)
aaggatccttaattaaattaatcccccccccccggcccggcggggccacgccttttccggcccgcagcgcggcctgggctcccgcgtgtttaaaagtgcgcttgtggctgctgctgtcttaactcctgtgcttggcggacagacaggcgagatggcggcggaggtgttgccgagtgcgaggtggcagtattgtggggcgcccgacgggagccagagagctgtactggtccagttctccaacgggaagctacagagtccaggcaacatgcgctttaccttgtatgagaacaaagattccaccaaccccaggaagaggaatcaacggatcctggcagctgaaacagataggctctcctatgtgggaaacaattttgggactggagccctcaaatgcaacactttgtgcaggcactttgtgggaattttgaacaagacctctggccaaatggaagtatatgatgctgaattgttcaacatgcagccactattttcagatgtatcagttgagagtgaactggcgctagagagtcagaccaaaacttacagagaaaagatggattcttgtattgaagcctttggtaccaccaaacagaagcgagctctgaacaccaggagaatgaacagagttggcaatgaatctttgaatcgtgcagtggctaaagctgcagagactatcattgatacgaagggtgtgactgctctggtcagcgatgctatccacaatgacttgcaagatgactccctctaccttcctccctgctatgatgatgcagccaagcctgaagacgtgtataaatttgaagatcttctttcccctgcggagtatgaagctcttcagagcccatctgaagctttcaggaacgtcacgtcagaagaaatactgaagatgattgaggagaacagccattgcacctttgtcatagaagcgttgaagtctttgccatcagatgtggagagccgagaccgccaggcccgatgcatatggtttctggataccctcatcaaatttcgagctcatagggtagttaagcggaaaagtgctctgggacctggagttccccacatcatcaacaccaaactgctgaagcactttacttgcttgacctacaacaatggcagattacggaacttaatttcggattctatgaaggcgaagattactgcatatgtgatcatacttgccttgcacatacatgacttccaaattgacctgacagtgttacagagggacttgaagctcagtgagaaaaggatgatggagatagccaaagccatgaggctgaagatctccaaaagaagggtgtctgtggccgccggcagtgaagaagatcacaaactgggcaccctgtccctcccgctgcctccagcccagacctcagaccgcctggcaaagcggaggaagattacctagacgcatgctttccagacagggcgttttggctgcatcacagccactggctggtcctattcatttccatttttatgtatgtt

SEQ ID NO: 142 - DNA, 2310 bp, Homo sapiens
  CDS (1)..(1374)
atggcccggcggcggcgccgcgcctgcatcgctctgttcctggtgctgctcttcgccttcggcaccctcatgggtctgcgcacgctcaaggctccggacggactcccggcgctgggcccgggcctggagctggcgccctttgagcgacgcccagagggggcccccgcgcccgctgccagggccccggcagcccctgccgcgccgcccccgccgccgccgccgccccgcaccgcggaccctggcggctcccctgggccggcacccgcggaggccgagcccgcccccgtgcagagcctgcgcgtctactcggacctgcacgccttctactactcgtggtacgggagcccgcggcgcgagggccactacattcactgggaccacgtcatggtgccgcactgggaccccaagatctcggccagctacccccgcggccgccacagccccccagacgacttgggctccagcttctacccggagctggggccctacagctcccgggaccccgaagtgctgcgggagcatatgacccagctcaaggaagccgccatcggcgtcctggtcctgtcctggtacccacctggcatggctgatgataacggggagccctcagatgacctggtgcccgccattctggacaccgcccatcagtacagcatccaggtggccttccacatccaaccctacaagggccgggatgacatcactgtacatgacaacatcaagtacatcattgacacgtatggctcccatggtgcattttaccgctataagaacagcatgggcaagagcctcccactcttttatatctacgactcatacctgacgtcccctgaggcctgggcccacctcctgacaccaaacgggccccattcgatccgcaacacgccctacgatggggtcttcatagcgctgctggtggaggagggccacacccacgatatcctggccgccggatttgacggcatgtacacctactttgcctccaatggtttctcctttggttcttcccatcagaactggaaagctgtgaagaacttttgtgatgccaacaacctcatgttcatccccagtgtggggcctggctacatagacaccagcattcggccctggaacaaccacaatacgcgcaacagggtcaatggcaagtactatgagacggccctgcaggcggccctgacagtgaggcccgagatcgtttccattacctccttcaatgagtggcacgagggcacccagattgagaaggccattcccaagaagacacccacccgcctgtatttggactacctgcctcaccagcccagcctgtacctggagctgacacgccgctgggcggagcacttcatcaaagagaaggagcagtggctcatgtgaggggcctgtaaatgggcgtgaggtgctgatgtccttgccttgctggaagatgtcaccatgtggggttcagctgaggttgtagccactcactcgttcccaggtcagaggtcagcagatgggtgtttctgggtgggccgtcaggcatgggcctgtgcaacacagagcccgttcctcaggcgagtggtgctgaggtgctctgtggtgatgggaacggcagaggctggcaggtgactgaacttagcccagggcagctccacatcctgggaacactttcatgtaaccccttctagttttgaactctgcagcaggctggtgctgtgtagtggccacccagtcaccacccttggaagggtgtcagggtctgggctcgcatgcaccctgctcccttctgccagcctgcatcctctcctcaggcctccttcccacatcatctgtcttctctaagttagggaaccatatttgagactttcaaaaagggaacttctaggtttaagctcctcccagtagattcctgaacccaattatcaggaaatcatcctgagcactcacaggttcatttaacactcactcatcaagcaccttcctatgtgctaggtgctggggaaaacttgaccaaggaagagttcctgtcctgaagcttccaggacccagctttccttttctggtgtggccttgtagctagtgcctgggcacaggtgtttttctttttgcagttttacctagtgctgggagttcagttctttttcctctagaaaaatacctctgtgctccagagcctaatttttcccagatgcatatttagctctagggagaggactaggaggaaatccccctccctttagctgcctgaactgaggcccactcactagagccatgttcagtgctactgtgattagtagtaattaaatatgaactggtattctcaaaaaaaaaaaa

SEQ ID NO: 143 - DNA, 7244 bp, Homo sapiens
  CDS (714)..(6518)
gaccatcaccctaacacccagcgcagagacagatgtatccctgtgtctacctgtggcttcatctacccaatgctgcctggagtggccatgtgtggaccagtgtgcttgagtgatgtggcctgtgtggacgcgggcccagcgcctacacgtccttgccctggatgtgccctgtgtgccctgacactgtgatgaacatggagtgagtgtgtgtgtgcgcttgtggttgtgctcatcagtgagaatgtgagactgctgtgctgtgctgcagctgccctgtggtctgctctgcctcttccctctgcctgtgtgctgtggaccacaatgtattgcatgtagatgatccatgtggccatgctcaactggctctgtgcatgtgccctgtggcacatgctgagctaactacttgcttgtgtgtgatctgtgacttgtgttgttgccatgtgatggtgcatgctgagatctccttcttcttcctggagccctacctgctcgtcgtcctgcacctcctattcttcctgcctggtgcttgcttggcagaccagggctgtggctggtgcctgaccatgtgccaccttgccaccttgcgccagggctgtgagcccattgctgggggattgaccggtgcttggtgtggtccctgcttgggtgcttggttgcctaccctcttgccactctgctgatggagcatctgtggacttgccacgcctgcacccatggaccccttctgtgagtggcatcagagcaccagccgcaaaggggacgcggcatgcagccggcggggccggggtcggggtgccctgaagagtccagaggagtgtcccccgctctgcagccagcgactgacctgtgaggactgcctggccaactctagccagtgcgcctggtgccagtccacccacacctgcttcctgtttgctgcctacttggcccggtacccacacgggggctgtcgaggctgggacgacagtgtacactcggagccacggtgccggagctgcgatggcttcctgacctgccatgagtgtctgcagagccacgagtgtggctggtgtggcaatgaggacaaccccacactgggacggtgcctacagggggacttctcagggcccctcggtgggggtaactgctccctgtgggtgggggagggcctggggcttcccgtggccctccctgcccgctgggcatacgcccgctgtcctgacgtggatgagtgtcgcctgggcctggcccggtgccacccgcgggcgacctgcctgaacacgcccctcagctacgagtgtcactgccagcggggctaccagggtgatggcatctcacactgcaaccgcacgtgcttggaggactgtggccatggtgtgtgcagtggccccccggactttacctgcgtgtgtgacctaggctggacatcagacctgccccctcccacacccgccccgggtccgccagccccccgctgctcccgggactgtggctgcagcttccacagccactgccgcaagcggggccctggcttctgcgacgagtgccaggactggacatggggggagcactgcgaacgatgccggcccggcagcttcggcaacgccacaggctctaggggctgccggccctgccagtgcaacgggcacggggacccacgccgtggccactgcgacaacctcagtgggctctgcttctgccaggaccacaccgagggtgcccactgccagctctgctccccaggctattatggggatccccgggccggtggttcctgctttcgggagtgtgggggtcgcgccctcctcaccaacgtgtcctcagtggcactgggctcacgccgggtcggggggctgctgcctccaggtggcggggctgcaagagccgggcctggcctgtcctactgtgtgtgggttgtctcggccactgaggagctacagccctgtgctcccgggaccctctgtcccccactcaccctcaccttctcccccgacagcagcaccccctgcacgctgagctacgtcctggcgtttgatggattcccacgcttcctggacactggtgttgtccagtcggaccgcagcctcatagctgccttctgcggccagcgacgggacaggcccctcactgttcaggccctgtctgggctgctcgtgctgcactgggaggccaatggctcctcatcctggggcttcaatgcttcggtgggctctgcccgctgtgggtcagggggccccgggagctgtcccgtcccccaggaatgcgtgccccaggacggtgctgcaggtgcggggctctgccgatgtcctcagggctgggctggcccacactgccgcatggctctgtgtcctgagaactgcaatgcccacactggggcaggaacttgtaaccagagcctgggtgtgtgcatctgtgccgagggcttcgggggccccgactgcgccaccaagctggatggcgggcagctggtctgggagaccctcatggacagccgcctctcagccgacactgccagccgcttcctgcaccgcctgggccacaccatggtggatggacccgatgccaccttgtggatgtttgggggcctgggcctgccccaggggctgctgggaaacctgtacaggtactcagtgagtgagcggcggtggacacagatgctggcgggagccgaggacgggggcccaggcccatcgccccgctccttccatgcagccgcatatgtgcccgctggccgtggtgccatgtatctgctggggggacttaccgctggaggcgtcacccgtgatttctgggtcctcaacctcaccaccctgcaatggcggcaggagaaggccccccagaccgtggagctgccagccgttgctggtcacacccttactgcccgccgaggcctgtctctgctcctggtgggcggttactccccggaaaatggcttcaaccagcagctgctggagtaccagctggcaaccggcacctgggtgtcaggagcccagagtgggacaccccccacaggtctctatggtcactctgctgtctaccacgaggccaccgactccctctacgtgtttggggggttccgattccatgtggagctggcggccccatcccccgagctctactccctgcactgtcctgaccgcacctggagtctgctggccccttctcagggggcaaagcgagatcgtatgaggaatgtgcgtggctcatctcggggtctgggccaagttcctggggagcagcctgggtcatgggggttccgggaagtcaggaagaagatggctctgtgggctgctcttgctggtacaggaggtttcctggaggaaatctcacctcacctgaaggagccccgcccccggcttttccacgcctcagccctgttaggggacaccatggtggttcttggggggcgctcggaccctgacgagttcagcagcgacgttctgctctaccaggtcaactgcaatgcctggcttctgcccgacctcacccgctcggcctctgtggggcccccaatggaggagtctgtggcccatgctgtggcagcagtcgggagccgcctgtatatctctgggggtttcgggggagtggccctgggccgcctgctggcactgaccctgccccctgacccctgccgcctgctgtcctcacctgaagcttgtaaccagtctggggcctgcacctggtgccatggggcctgcttgtccggggatcaggcccacaggctgggctgcgggggctccccctgctccccaatgcctcgctccccggaggaatgtcgacgtctccggacctgcagtgagtgcctggcccgccatcctcggaccctgcaacctggagatggagaggcgtccaccccccgctgtaagtggtgtaccaactgccccgaaggtgcttgcattggacgcaatgggtcctgcacctctgagaatgactgtcggatcaaccagcgagaggtcttctgggcagggaactgctccgaggctgcgtgcggggctgctgactgcgagcagtgcacgcgggagggcaagtgcatgtggacgcggcagttcaagaggacaggggagacccgccgcatcctctccgtgcagcccacctatgactggacgtgcttcagccactctctgctgaatgtgtcccccatgccggtggaatcatcacccccactgccctgccccaccccttgtcacctcctacccaactgtacctcctgcctggactctaagggagcagatgggggctggcagcactgtgtttggagcagcagcctgcagcagtgtctgagcccttcctacctgcccctgcgatgtatggccggaggctgtgggcggctgctccggggacctgagagctgctccctgggctgtgctcaggcaactcagtgcgccttgtgcctgcggcgcccccattgcggctggtgtgcctgggggggccaggatgggggtggccgctgcatggagggtggactcagcggcccccgtgatgggctgacatgtgggcgtccgggggcctcctgggccttcctgtcctgcccccctgaggacgagtgtgcaaacgggcaccacgactgcaacgagacgcagaattgccacgaccagccccacggctatgagtgcagctgcaagaccggctataccatggacaacatgacagggctgtgccgccctgtgtgcgcccagggctgcgtgaacggctcatgtgtggagcccgaccactgccgctgccactttggctttgtgggccgcaactgctccacggaatgccgctgcaaccgccacagtgaatgcgctggtgttggggcgcgtgaccactgcttgctctgccgcaaccacaccaagggcagccactgtgagcagtgcctcccgctgtttgtgggttcagctgtcggaggcgggacctgccggccctgccacgccttttgtcgtggaaatagccacatctgcatctccaggaaggagttacaaatgtccaagggagagccaaagaagtactcactggacccagaggagattgaaaactgggtgacagagggtcctagtgaagacgaggccgtgtgcgtgaactgccagaataacagctatggggagaaatgcgagagctgcctgcagggctacttcctcctggacgggaagtgcaccaaatgccagtgtaatggccacgcggacacatgtaacgagcaggatgggacgggctgtccatgtcagaataacacagagacgggcacatgccagggcagctcccccagtgaccgtcgagactgctacaagtaccagtgcgccaagtgccgggaatcatttcacgggagtccgctgggcggccagcagtgctaccgcctcatctcggtggagcaggagtgctgcctggaccccacgtcccagaccaactgcttccatgagcccaaacgccgggcgctaggccccggccgcactgtcctctttggcgtgcagcccaaattcaccaacgtggacatccgcctgacgctggacgtgaccttcggggccgtggacctctatgtctccacctcctatgacaccttcgtggtccgtgtggcccctgacactggcgtccatactgtacacatccagccacccccagccccaccacctccaccaccccctgcagatggtgggccccggggggctggggatccaggaggagcaggggccagcagtgggccgggcgccccagcagagccacgggtacgggaggtatggccgcggggcctgattacctacgtgacggtgacggagccgtcggcagtgctggtggtccgcggcgtgcgggaccggctggtcatcacctacccacacgagcaccatgccctcaagtcgagccgcttctacctgctgctgctgggcgtgggagacccaagtgggcccggcgccaacggctcagccgactcgcagggcctgctcttcttccggcaggaccaggcccacattgacctgtttgtcttcttctccgtcttcttctcctgcttcttcctcttcctctcactctgtgtgctcctctggaaggccaagcaggctctggaccagcggcaggagcagcgccggcacttgcaggagatgaccaagatggccagccgccccttcgccaaggtcaccgtctgcttcccacctgaccctactgccccggcctccgcctggaagccggctgggctcccacctcccgccttccgccgctctgagcccttcctggcacccctgctgctgacaggggccggtgggccctggggacccatgggagggggctgctgcccaccagccatccccgccaccactgctgggctgcgagctgggcccatcactctcgagcccacagaagatggcatggctggcgtggccacactgctgctccagctgcctggcgggccccatgcacccaacggcgcctgcctggggtcagccctcgtcacactgcggcacaggctgcacgagtactgtgggggtggtgggggtgctgggggcagtgggcatgggactggtgcgggccggaagggactgttgagccaggacaacctcaccagcatgtccctctgacatgcccagggttctcatccacagcagctgggtcacctgatagggccgccctggacttggggtccctccacctgggggcccctggacactgtctacttggagaccactggcccccttcccccagggttgcccagatggggcctcctttgttctgcattcagcagctatttatcgagtacctactctgtcaggcactgtcataggcgtggggcaaagcaggaaccaagagacgaggttccctgatctcatgggacttaggttctggtgaagggagacaatcagtgcacatgcacacaccccacacgcatacacacatgaacacatgcacatgtgcacacacaagtaagatggcttcagagagggagaagcactgtgaggcctccagaggatgtggcagtgagggacgatggggtgaagtcagctgggcattcaaagaagctagactgagaacgcctgagaagaaccagctacgggaagagctttgggaagcaaaggcagaggccctggggtgggagcaggcttgttttattggaaggaccagaaaactggtaagtgtgacccagatcaagtgtgaggagatgaggctggggatagtcaggggctggatcacccagggccttgtgggccccacatagggttttgggttttattctcagggcaatgggaagctgttggatggtttgatgaaggggagtgacaggatccgatgtacctatttaagaattt

SEQ ID NO: 144 - DNA, 2365 bp, Homo sapiens
  CDS (59)..(1861)
ggggctgggcggcggggacagcggggacggcacggcgcgcgcagcttctaagtgccagatgatggaggagcgtgccaacctgatgcacatgatgaaactcagcatcaaggtgttgctccagtcggctctgagcctgggccgcagcctggatgcggaccatgcccccttgcagcagttctttgtagtgatggagcactgcctcaaacatgggctgaaagttaagaagagttttattggccaaaataaatcattctttggtcctttggagctggtggagaaactttgtccagaagcatcagatatagcgactagtgtcagaaatcttccagaattaaagacagctgtgggaagaggccgagcgtggctttatcttgcactcatgcaaaagaaactggcagattatctgaaagtgcttatagacaataaacatctcttaagcgagttctatgagcctgaggctttaatgatggaggaagaagggatggtgattgttggtctgctggtgggactcaatgttctcgatgccaatctctgcttgaaaggagaagacttggattctcaggttggagtaatagatttttccctctaccttaaggatgtgcaggatcttgatggtggcaaggagcatgaaagaattactgatgtccttgatcaaaaaaattatgtggaagaacttaaccggcacttgagctgcacagttggggatcttcaaaccaagatagatggcttggaaaagactaactcaaagcttcaagaagagctttcagctgcaacagaccgaatttgctcacttcaagaagaacagcagcagttaagagaacaaaatgaattaattcgagaaagaagtgaaaagagtgtagagataacaaaacaggataccaaagttgagctggagacttacaagcaaactcggcaaggtctggatgaaatgtacagtgatgtgtggaagcagctaaaagaggagaagaaagtccggttggaactggaaaaagaactggagttacaaattggaatgaaaaccgaaatggaaattgcaatgaagttactggaaaaggacacccacgagaagcaggacacactagttgccctccgccagcagctggaagaagtcaaagcgattaatttacagatgtttcacaaagctcagaatgcagagagcagtttgcagcagaagaatgaagccatcacatcctttgaaggaaaaaccaaccaagttatgtccagcatgaaacaaatggaagaaaggttgcagcactcggagcgggcgaggcagggggctgaggagcggagccacaagctgcagcaggagctgggcgggaggatcggcgccctgcagctgcagctctcccagctgcacgagcaatgctcaagcctggagaaagaattgaaatcagaaaaagagcaaagacaggctcttcagcgcgaattacagcacgagaaagacacttcctctctactcaggatggagctgcaacaagtggaaggactgaaaaaggagttgcgggagcttcaggacgagaaggcagagctgcagaagatctgcgaggagcaggaacaagccctccaggaaatgggcctgcacctcagccagtccaagctgaagatggaagatataaaagaagtgaaccaggcactgaagggccacgcctggctgaaagatgacgaagcgacacactgtaggcagtgtgagaaggagttctccatttcccggagaaagcaccactgccggaactgtggccacatcttctgcaacacctgctccagcaacgagctggccctgccctcctaccccaagccggtgcgagtgtgcgacagctgccacaccctgctcctgcagcgctgctcctccacggcctcctgaacgtccgtcctcaggagcacagcctcacggacagtgccaaaccctgtgggtctccaggggcttgggaaatgtgttctttcccaagagtatcaaaggaaagaatcaaatttcttgcccggtcactggcactccagaagacagcgtgccggaaccggcagctctcacctttctgtgacttgttcggaattaactcctctggatggaaacttccatcttacttggttacatcacggctctggttcagatacaacttcatgattttgctactatcatttttcacttttcaaagaatttaacctattttacagcagttcagttctgctagtgagtagttttcctctcctaccttccttctaaaaacctgattcatgcacggcgtttgacacacatggagtctgccagtgtgccttctctgcttcagacaagagatctgccatttcatgcccttgtgactacctatcattggccctgcaataaaatcatttatttttcaaaaaaaaaaaa

SEQ ID NO: 145 - DNA, 2948 bp, Homo sapiens
  CDS (133)..(1980)
ggccgctggtagggccggccggccggcgggcggagcccccccgccgacgcacacgaggtgaccaggcattgatgcacccccaggaaggccacgggctcaggaggcccccccgccccgctggctgctgctcacatggtgtctgggcccttggcactccggtggtgcgcgtgggcagggcgcggggacatggggcccgacatggagctgcccagccactcgaagcagctcctgctgcagctgaaccagcagaggaccaagggcttcctgtgtgacgtcatcatcatggtggagaactccatcttccgggcccacaagaacgtcctagccgccagcagcatctatttcaagtccctggtcctgcacgacaacctcatcaacctggacacagacatggtcagctccacagtgttccagcagatcttggacttcatctacacaggcaagctgctgcccagcgaccagccagccgagcccaacttcagcaccctcctcactgccgccagctacctccagctgcccgagttggcagccctctgccgccgcaaactcaagcgagccggcaagccctttggctctgggagggcggggtccactggcatggggcggcccccccgcagccagcggctgtccacggcctctgtcatccaagctcggtatcaggggctcgtggatgggcgcaagggggcccacgccccccaggagctcccccaagccaaaggctcagacgatgaactctttcttggtggctctaaccaggatagcgtgcaaggtctgggccgggctgtctgcccagctggcggggaggcgggtctggggggctgcagcagcagcaccaacgggagcagcgggggctgcgagcaggagctgggcttggacctgtccaagaaaagcccacccttgccccctgccaccccaggtccccacctcactcccgatgacgcagcccagctgagcgacagccaacatggctcgccccctgcggcctctgctcctcccgttgccaacagtgcctcttattctgagctggggggcacccctgatgagcccatggatctggagggggccgaggacaaccacctgagcctgctggaggcgcctggtgggcagcctcggaagagcctccggcactccactcggaagaaggagtggggcaagaaggagcctgtggctggctccccctttgagcggagagaagcagggcccaagggtccctgcccgggagaggagggtgagggggtcggggacagggttcccaatggcatcctggctagtggggctggccctagcgggccctatggggagcccccctacccctgcaaggaggaggaggagaacggcaaggatgcaagtgaagacagtgcgcagagcgggagcgaggggggcagcggccatgccagcgcccactacatgtaccggcaggagggctacgagacggtgtcctacggggacaacttgtatgtgtgcattccctgcgccaagggcttccccagctctgagcagctcaatgcgcacgtggagactcacacggaggaagagctgttcatcaaggaagagggggcctacgagacaggcagtgggggtgccgaggaggaggccgaggacctgtcagcacccagtgcggcctacacggctgagccccggcccttcaagtgttcggtctgcgagaagacctacaaggacccagccacgctgcggcagcacgagaagacgcactggctgacacggcccttcccctgcaacatctgtggcaaaatgttcacgcagcgcggcaccatgacgcgtcacatgcggagccacctgggcctgaagcccttcgcctgcgatgagtgtggcatgcgcttcacccgtcagtaccgcctcacggagcacatgcgtgtgcactcgggcgagaaaccttacgagtgccagctgtgcgggggcaagttcacccagcagcgcaacctcatcagccacctgcgcatgcacacctccccctcctagaagccaaaagcaccgcgggcggcccatcatgccaacctttgcatccccgggaacccatggaagggagaagcgaggtgatagcagcaggcagggggcaagcaccctgggtccaagttggaaggctcctgggtggcccctctggcccccactgcccacacccagagctttaatggacagtccgtaccaagcagagccgagaggagggaagccaggggtcccagcccgtctacctccccatcccacccagggccgcatgctccccgcggggagccaccgcagggcctgtgggctgggtcacgtgggtctcgctgggacctggtccctttgttgcaggcggcttggagaaagggcagtgggacgctggccacggccagggtggtgtcgggagcaggcctcaccccgctggccgtgtctgtgtgtgtgcacgtgtgcttgtgtctgtgcgggcgcgtgcagccctggttctgcagggaacaggtgctgggggtgcagatccctccctccttgagccagggtggcactgttcactggcgctgggacagtcagggtgaccccaccgcctacctctctacaactaaagagccctctgggcctgtgttgctgttattcctactgatctgttcctctgtttttctttttgatttttgttttttaaaccaaaacagacaatagcttattttctttccgccccctccggggctgagcctgggtctgaagactgaatgtaacaggggccgctggcactcctgcgcgtcccccggctctggcgctgcaggggtgtcggcgcgccacctctccaggccccagaagcccttcttgcccaaaggcttccctggtccctgagccctgcctcggctgcctcaggggagagtgcttttcctgtagtttccaaggaatattctttgtttagaggtacttgttttttattaagagaaaaaccagtgtaacgttaaaaaaaaaaaaaaaag

SEQ ID NO: 146 - DNA, 1625 bp, Homo sapiens
  CDS (160)..(1239)
aaggatccttaattaaattaatcccccccccccggtcggcctaggtgcgctgcgagcgcgcgcggaccgcgcacaggcggcggagccggtatgggcccgcctgaccctgggcgccgcgccgcacgagcaccagcctagagccaggactgaagcttcaagatggctgaccaggaccctgcgggcatcagccccctccagcaaatggtggcctcaggcaccggggctgtggttacctctctcttcatgacacccctggacgtggtgaaggttcgcctgcagtctcagcggccctccatggccagcgagctgatgccttcctccagactgtggagcctctcctataccaaattgccctcctctctccaatccacagggaagtgcctcctgtattgcaatggtgtcctggagcctctgtacctgtgcccaaatggtgcccgctgtgccacctggtttcaagaccctacccgcttcactggcaccatggatgccttcgtgaagatcgtgaggcacgagggcaccaggaccctctggagcggcctccccgccaccctggtgatgactgtgccagctaccgccatctacttcactgcctatgaccaactgaaggccttcctgtgtggtcgagccctgacctctgacctctacgcacccatggtggctggcgcgctggcccgcctgggcaccgtgactgtgatcagccccctggagcttatgcggacaaagctgcaggctcagcatgtgtcgtaccgggagctgggtgcctgtgttcgaactgcagtggctcagggtggctggcgctcactgtggctgggctggggccccactgcccttcgagatgtgcccttctcagccctgtactggttcaactatgagctggtgaagagctggctcaatgggttcaggccgaaggaccagacttctgtgggcatgagctttgtggctggtggcatctcagggacggtggctgcagtgctgactctaccctttgacgtggtaaagacccaacgccaggtcgctctgggagcgatggaggctgtgagagtgaaccccctgcatgtggactccacctggctgctgctgcggaggatccgggccgagtcgggcaccaagggactctttgcaggcttccttcctcggatcatcaaggctgccccctcctgtgccatcatgatcagcacctatgagttcggcaaaagcttcttccagaggctgaaccaggaccggcttctgggcggctgaaaggggcaaggaggcaaggaccccgtctctcccacggatggggagagggcaggaggagacccagccaagtgccttttcctcagcactgagggagggggcttgtttcccttccctcccggcgacaagctccagggcagggctgtccctttgggcggcccagcacttcctcagacacaactttttcctgctgctccagtggtggggatcatcacttacccaccccccaagttcaagaccaaattttccagctgccccctttgtgtttccctgtgtttgctgtagctgggcatgtctccaggaaccaaaaagccctcagcctggggtagtctccctgacccttgttaattccttaagtttaaagatgatgaacttcaaaaaaaaaaaaa

SEQ ID NO: 147 - DNA, 2717 bp, Homo sapiens
  CDS (115)..(2688)
tccccccctcccccattccgctaggtacgaggctgggtgttgcacgtgtcttagggtagcgcgcgcctgtctctcttcgggtctcgggcccttgggcgcagcggggcgcgcgccatggcgaaggcgaagaaggtcggggcgcgaaggaaggcctccggggcgccggcgggagcgcgagggggcccggcgaaggccaactccaatccgttcgaggtgaaagttaacaggcagaagttccagatcctgggccggaagacgcgccacgacgtgggactgcccggggtgtctcgcgcacgggccctcaggaagcgtacacagactttactaaaagagtacaaagaaagggataaatccaatgtattcagagataaacgcttcggagaatacaacagcaacatgagccccgaggagaagatgatgaagaggtttgctctggaacagcagcgacatcatgagaaaaaaagcatctacaatctaaatgaagatgaagaattgactcattatggccagtctttggcagacatcgagaagcataatgacattgtggacagtgacagcgatgctgaggatcgaggaacgttgtctgctgagctgactgctgcccactttggaggaggcggtgggctccttcacaagaagactcaacaggaaggcgaggagcgggagaaaccgaagtcccggaaagagctgattgaagagctcattgccaagtcaaaacaagagaagagggagagacaagctcaacgagaagatgccctcgagctcacggagaagctagaccaagactggaaagaaattcagactctcctgtcccacaaaactcccaagtcagagaacagagacaaaaaggaaaaacccaagcccgatgcatatgacatgatggttcgcgagcttggctttgaaatgaaggcgcagccctctaacaggatgaagacggaggcagaattggcaaaggaagagcaggagcacctcaggaagctggaggctgagagacttcgaagaatgcttggaaaggatgaggatgaaaatgttaagaaaccaaaacatatgtcagcagatgatctgaatgatggcttcgtgctagataaagatgacaggcgtttgctttcctacaaagatggaaagatgaatgtcgaggaagatgtccaggaagagcaaagcaaggaagccagtgaccctgagagcaacgaggaagaaggtgacagttcaggcggggaggacacagaggagagcgacagcccagatagccacttggacctggaatccaacgtggagagtgaggaagaaaacgagaagccagcaaaagagcagaggcagactcctgggaaagggttgataagcggcaaggaaagagctggaaaagctaccagagacgagctgccctacacgttcgcagcccctgaatcctatgaggaactgagatctctgttgttaggaagatcgatggaagagcagcttttggtggtggagagaattcagaagtgcaaccacccgagtctcgcagaaggaaacaaagcaaaattagaaaaactgtttggctttcttttggaatacgttggcgatttggctacagatgacccaccagacctcacagtcattgataagttggttgtgcacttatatcatctttgccagatgtttcctgaatctgcaagtgacgctatcaaatttgttctccgagatgcgatgcatgagatggaagaaatgattgagaccaaaggccgggcggcattgccagggttggatgtgctcatttatttgaaaatcactgggctgctatttccaacttccgacttctggcacccagtggtgacccctgccctcgtgtgcctcagtcagctgctcaccaagtgccccatcctgtccctccaggacgtggtgaagggcctgttcgtgtgctgcctgttcctggagtatgtggctttgtcccagaggtttatacctgagcttattaattttcttcttgggattctttacatagcaactccaaacaaagcaagccaaggttccactctggtgcaccctttcagagcgcttgggaagaactcggaactgctcgtggtgtctgctagagaggatgtggccacgtggcagcagagcagcctctccctccgctgggcgagtagactgagggccccaacttcgacagaggccaatcacatccgactgtcctgcctggctgtgggcctggccctgctgaagcgctgcgtgctcatgtacgggtccctgccatccttccacgccatcatggggcctctccgagccctcctcacggatcacctggcggactgcagccacccgcaggagctccaggagctgtgtcagagcacactgaccgaaatggaaagccagaagcagctctgccggccgctgacctgtgagaagagcaagcctgtcccactgaagcttttcacaccccggctggtcaaagtcctcgagtttggaagaaaacaaggcagtagtaaggaggaacaggaaaggaagaggctgatccacaaacacaagcgtgaatttaaaggggccgttcgagaaatccgcaaggacaatcagttcctggcgaggatgcaactctcagaaatcatggaacgggatgcggaaagaaagcggaaagtaaagcagctttttaacagcctggctacacaggaaggcgaatggaaggctctgaagaggaaaaagttcaaaaaataaattacattttataaataaaaaaaaaaaaa

SEQ ID NO: 148 - DNA, 4432 bp, Homo sapiens
  CDS (1129)..(2817)
gacgggaggctgatgcaggtttcccgcgacctgacagcatggagtggggacggcgggtgttctgtgttgagatgccagctgaaggacgtggtgtttttacagatgcctgctctgtgcctgtatctgagatcatcgccgttgaggaaacagacgttcacgggaaacatcaaggcagtggaaaatggcagaaaatggaaaagccttacgcttttacagttcactgtgtaaagagagcacgacggcaccgctggaagtgggcgcaggtgactttctggtgtccagaggagcagctgtgtcacttgtggctgcagaccctgcgggagatgctggagaagctgagtacgtgtgtgtttggactgagagacaggatggccgtggtggcatgcgcatgcctgattgggtgatcttcctgaagtgtctccccgtttcgtgcagctggccataccccaggtggacatgatgagtcaggctgacttaatttctcatgagcagaccatcccagtgaatgcaaagggcatgggctccacagcctggaccctggcatggagtccagccccctgctcaccggccaggaggcctgggggcgggtcacttacccttctgagcctcagtttctctttctggaagcggagatggtaatagcttttacattcgaggtgaatacttcctgccctggctgtcagccgccagccagccctgattcggagactgtttacccccgagtggatgatggcagcctggccaaggagcatccggtgcccacctatacaagaggccactccgtcgagtggacggaggtagacaccggctctcagcagcagcgacgtcgtactggctctgtgctaggctccatccgggcatctgtctctcggctgtcctctgggggctgtgtccacatcagccagaccctgagtggggagtacagccctccaagtgcctctggctgctgcctggggacagaagtccctccagagagtttggacttgaatcttgagctctcagccactctgttctgcgatcactatcctcgtttcacgtgtgagagaaaacggaggctccaacaggactgtcctggggccttcactgcatggcctgaacaggggctgggctcccagggaggaatgattcatggctggttcccgccctatagacaagacagtcacaaggagctggcaggcctggcggacgagcccggcggcggagatgggggcgacgggggcggcggagccgctgcaatccgtgctgtgggtgaagcagcagcgctgcgccgtgagcctggagcccgcgcgggctctgctgcgctggtggcggagcccggggcccggagccggcgcccccggcgcggatgcctgctctgtgcctgtatctgagatcatcgccgttgaggaaacagacgttcacgggaaacatcaaggcagtggaaaatggcagaaaatggaaaagccttacgcttttacagttcactgtgtaaagagagcacgacggcaccgctggaagtgggcgcaggtgactttctggtgtccagaggagcagctgtgtcacttgtggctgcagaccctgcgggagatgctggagaagctgacgtccagaccaaagcatttactggtatttatcaacccgtttggaggaaaaggacaaggcaagcggatatatgaaagaaaagtggcaccactgttcaccttagcctccatcaccactgacatcatcgttactgaacatgctaatcaggccaaggagactctgtatgagattaacatagacaaatacgacggcatcgtctgtgtcggcggagatggtatgttcagcgaggtgctgcacggtctgattgggaggacgcagaggagcgccggggtcgaccagaaccacccccgggctgtgctggtccccagtagcctccggattggaatcattcccgcagggtcaacggactgcgtgtgttactccaccgtgggcaccagcgacgcagaaacctcggcgctgcatatcgttgttggggactcgctggccatggatgtgtcctcagtccaccacaacagcacactccttcgctactccgtgtccctgctgggctacggcttctacggggacatcatcaaggacagtgagaagaaacggtggttgggtcttgccagatacgacttttcaggtttaaagaccttcctctcccaccactgctatggagggacagtgtccttcctccctgcacaacacacggtgggatctccaagggataggaagccctgccgggcaggatgctttgtttgcaggcaaagcaagcagcagctggaggaggagcagaagaaagcactgtatggtttggaagctgcggaggacgtggaggagtggcaagtcgtctgtgggaagtttctggccatcaatgccacaaacatgtcctgtgcttgtcgccggagccccaggggcctctccccggctgcccacttgggagacgggtcttctgacctcatcctcatccggaaatgctccaggttcaattttctgagatttctcatcaggcacaccaaccagcaggaccagtttgacttcacttttgttgaagtttatcgcgtcaagaaattccagtttacgtcgaagcacatggaggatgaggacagcgacctcaaggagggggggaagaagcgctttgggcacatttgcagcagccacccctcctgctgctgcaccgtctccaacagctcctggaactgcgacggggaggtcctgcacagccctgccatcgaggtcagagtccactgccagctggttcgactctttgcacgaggaattgaagagaatccgaagccagactcacacagctgagaagccggcgtcccgctcacaaactgggaaagtgttaaaactatttaagataattattacagaccaattatgttgatatatacatttaaatgtagaaatttatttttgatagttaaatcttgattttagaagaaaacccttttgtcaacaattttgtgtacatatttggcattttcagttctgtacgcatctgcgggttgcagcccacgccgcttactctcagcggatgcagctgctcacttgggggcactggcctcttaggttttaacgatgtcaacagtgtagtttagaaaatggcccgttagtggctctattgcaataatgttagggacattatatgatttccacgcaggtcacaccatctgggcctgaggtagcagtgggtcactttgatccactttgcaggacttattctgtaacggtttgtggccaagttttgggaagtggttgattctctttgccttcatttcaccttcctcttcgtttacggttaggacatcgctgcttgatccttacaatactgtgcaactgcaatgcaacgtggccctgcttcaggtgatccgcgggaggggcctccacgccagcgccgggaaggctgctggggcctccacacctgcctcatcacggcggcgaggctacgacaatccggctgggagcatgaccttggcgtctgttctgggagcacggatgataagctctggaagctggcagtgtgtaaagcactggcaagtttgttactgttaaaatgtcaaataccaatgctttatatcgacgcgaagtgcttaacacagccgggcttgggggcagtcaggaggaagctggccatccgtggaggaggggccggtcctggactcccgcaggactcctctgatgcagggcctgaagtctgtacacgtggtccagatttgtccttgtcttttcttcacactgagttctctatatttattgaacatcttgtccttttaagccagagtagtgtaaactgcgtctcggatgtctgtcttttgcctcgaagccacgatggatcgctggtttcctctgcagcgcgagggctccggcgaccagaggattcttcccggaaggcattcctgccgcgctccccggggcacccctcaattgtgtactacgtccttgtttagtgtgtatccgtgcccacgtagatgatgtctgtaacgtagttttgtttgaaatatgagaatatgcggcttaaactttgatctgtaaggagcggggccgtggccgtttggagcacgctgtagacaccgttcctcatgctgccgggtgggttttgcagaagctcccttagtgatttcatgtttaacaggcagcatccattttcagaatttcctggcattgatttatattttgaagcatacaggaaacttctcgtttcctcgtttagccccacccagatcaggtgaaagggcagctttaatggtggtttttatggaccacattatcagagagcactgtgcaagccaaatggttcaataatgaatgaaaattctgggtgtaaagagtaaatatgccctggctctttctaccaatgcttgctcctgggtggaaagaaaccaaagatttaagacgggctgctcttccagactggctgggcctg

SEQ ID NO: 149 - DNA, 2708 bp, Homo sapiens
  CDS (185)..(2509)
cgtgttgttggcagctgtggctaaggaggggagaacctctgctccccgcccgtcttctcttctgcgtttcccgggctagggggcgtggggagtggttttaggcggcgaagccgctcggcagcaccttccttctttgccaggcagacgcccgttgtagccgttggggaaccgttgagaatccgccatggagccagagagggaagggaccgagagacaccccaggaaggtcagggaaagcaggcaggccccaaataagctggtcggggcagctgaggcgatgaaagccggttgggatctcgaggagagtcagcccgaggccaagaaagcccgcttatctaccattttatttactgacaactgtgaagtaacccatgaccagctgtgtgaattgctgaagtatgcagttctgggcaaatccaatgttccaaaacccagctggtgccagctttttcatcaaaaccacctaaacaacgtagtggtttttgttctgcagggaatgagtcagctacacttttacaggttctatttggagtttggatgtcttcgaaaagcattcagacataaattccgcttgcctccaccatcatctgattttctagctgatgttgttgggctacaaactgaacaaagagctggagatctgcccaagacaatggaagggcctttaccttctaatgcaaaagccgccatcaaccttcaggatgatcccatcattcaaaagtatggctctaagaaagtgggcttgaccagatgccttctgacaaaggaggaaatgagaacgtttcactttccattacaaggttttcctgattgtgaaaactttttacttaccaaatgtaatggttctatagcagacaatagtcctctctttggacttgactgtgaaatgtgcctcacatccaaggggagagagctaacacgcatctcactggttgctgaaggaggctgctgtgttatggatgaactggtcaaacctgaaaacaagattctggactacctcaccagcttttcgggaatcacgaagaagattcttaacccagtgacgaccaaactcaaagatgtacagaggcagttaaaagcactgcttcctcctgatgctgtgttagtgggccactccttagatttggatctcagagcactgaaaatgatacatccatatgttattgatacatcgttgctttatgtcagagagcagggcagaagatttaagctcaagttcttagccaaagttattttggggaaggatatacagtgtccagacagacttggtcatgatgccacagaagatgctagaacaatccttgaattggctcggtatttccttaagcatggcccaaaaaagattgcagaactaaatctagaagcactagctaatcaccaagaaatacaagcagcaggccaagagcctaaaaacacagcagaagtacttcagcacccaaacacaagtgttttagaatgcttggattcagtgggtcagaagcttctttttttgacccgggagacagatgctggtgaacttccatcttccagaaattgtcaaactattaagtgtctttcaaataaagaggttcttgagcaggccagagtggaaatccccctgtttcccttcagcattgttcagttctcttttaaggccttttcacctgtcctcactgaggagatgaacaaaaggatgaggatcaagtggacagagatatcaactgtctatgctgggccatttagcaaaaattgcaatctcagggctctgaagaggctgtttaaaagctttggcccagtccagtcaatgacttttgttcttgaaacccgtcagcctcatctctgtatacagtatgaagtcctagaagctgcccagctggccatagagtccttggatggtattctggtagatggtatctgcatcaaggtgcagaggcctgtgacagagctcacgcttgattgtgacaccctcgtgaatgagctggaaggagattctgaaaaccaaggctctatatatctgtctggagtgagtgaaaccttcaaagaacagctattgcaggagccccgcctctttcttggcctggaagctgtgatcttgcctaaagatcttaaaagtggaaagcagaaaaaatactgtttcctgaaattcaaaagttttggcagtgcccagcaggccctcaacattctcacaggcaaggactggaagctgaaaggcaggcatgccctaacccccaggcacctccatgcctggctcagaggcttaccacctgaatcaacaaggctcccagggcttcgtgttgtacctcccccctttgaacaggaggccttgcagactctgaaactggaccacccgaagatagcagcctggcgctggagccggaagattggaaagctctacaacagcttgtgcccgggcactctctgcctcatcctgctgccaggaaccaagagcactcatggttcactctctggtctaggactgatgggaataaaagaggaagaagaaagcgctggcccaggcctgtgttcgtgagtcggcctgccatgtttccatgtgccatttcttaccccttgtaggcaatggcaaagaatgtggtcaggctgtagcctccccaaccagcagacagttttatggaaacttggtatagcagctaaaagagtttagtttgtttatatggcatgtataagttttcaataaatgcctaaagttcaagcatagtaaaaaaaaaaaa

SEQ ID NO: 150 - DNA, 1939 bp, Homo sapiens
  CDS (156)..(1847)
ttcccgggtcgacgatttcgttaaaagttcacctttatatattcacaactacacatcttataaaaatcttggaaggtcttgttccatgaaacttttatccactctcaagtgggttaccctgcaatatatactctaatattattgtattttccttcatgttctcctgcgtagtttctgatgaagaacaatcagtagtatacgttccaggaatttctgctgaaggaaatgtcagatcaagacacaagctgatgagtccaaaagctgatgttaaacttaagacttccagggtgactgatgcttcaatctccatggagtccttaaaaggcacaggagattcagtagatgaacagaattcctgcaggggagaaataaagagtgcatcattgaaggatttatgtcttgaagacaaaagacgcattgcaaacttaattaaagaactggccagagtaagtgaggaaaaggaagtgacagaggaaagactgaaagctgagcaggagtcatttgagaagaagatcaggcagttggaagaacagaatgaactgatcatcaaagaaagggaagctcttcagctacagtatagagaatgccaagaacttctaagcctgtatcagaaatatttatcagaacaacaggagaagctcaccatgtctctctcagaacttggtgctgctagaatgcaggaacagcaggtatccagtagaaaaagcactctccagtgttcatctgtggaactggatggttcctacttgagcatagccagaccacagacctactatcaaaccaagcaaagacctaagtctgcagtccaggattcagcttcagaatcccttatagcatttaggaataattctttgaaaccagtaacccttcatcatcccaaagatgatctagataagataccatcagagaccacaacatgtaattgtgaatctccagggagaaaacctgcagtcccaacagagaaaatgccacaagaagaattgcacatgaaggaatgtccacatcttaagcctactcctagtcaatgctgtggtcatagacttgctgcagatcgtgttcatgacagccatcctacaaacatgacccctcaacatcctaagacacatccagaatcatgcagttattgtcggctttcttgggcatctctggtgcatggtggaggggcactgcaacccattgaaactttgaaaaagcagatctcagaagatagaaagcagcaactgatgcttcagaaaatggaactggaaattgaaaaggagcgccttcagcatctgctggcccagcaggagacaaagcttcttctaaaacagcagcagcttcaccagtctcgactggattacaattgtttattgaagtcaaactgtgatggctggctgcttggaacatcatcatctattaaaaagcaccaagaccccccaaacagtggagagaataggaaggagaggaagacagttgggtttcattcgcatatgaaagatgatgcccagtggtcatgtcaaaagaaagatacatgtagaccccaaagagggacagtgacaggagttagaaaagatgcgtctacatctcctatgccaacaggaagcctaaaggattttgtcaccacagcctcaccatcattacagcacaccacctcccggtatgagacatctttgttggatttggttcagtctctgagcccaaactctgcgcccaaacctcagcgctatccctccagagaagctggggcctggaatcatggtactttccgactcagtcctctaaaatcaacccggaagaagatggggatgcacagaacccctgaagagttggaggagaatcagattctggaagatatatttttcatttgacatattgcaaaattttcttaggaaatttgtgggtttcctcacatactgatctaggattttaaattatttcattgcaaagtaaaaaaaaaaaa

SEQ ID NO: 151 - DNA, 1696 bp, Homo sapiens
  CDS (13)..(1560)
cccggcgtgtccatgtgtcaggtgggcgaggactacggggagccggcgcctgaggagccgcccccggcgccgcggcccagccgtgagcagaagtgtgtgaagtgcaaggaagcgcagcccgttgtggtgatacgagccggagatgccttctgcagggactgtttcaaggccttctacgtccacaagttcagagccatgctgggcaagaaccggctcatctttccaggcgagaaggtgctcttggcgtggtctggggggccttcgtccagctccatggtctggcaggttcttgagggcctgagccaagattctgccaaaagactgcgctttgtggcaggagtcatctttgttgacgagggagcagcctgtggccagagcctagaggagagatcaaagaccctggccgaagtgaagcccattctgcaagcaactgggttcccatggcatgtggtggccttagaggaggtgttcagcctgccaccgtcggtgctttggtgctctgcccaggagctggtgggatccgagggggcctacaaggcggccgtggacagcttcctccagcagcagcatgtgctgggggccgggggtggtccctggcccgactcaaggggaggaacagccaccccagcccccgctggacccccagaacctggcaagaccgcctgccctgcccagactgaggctctttcccaactgttctgctcagtgaggacactgactgccaaggaggagcttctgcagaccctgcggacccacctgatcctccacgtggcccgagcccacggctactccaaggtcatgactggggacagctgcacacgcttggctatcaagctcatgaccaacctggcgctgggtcgaggggccttcctggcctgggatacgggcttctcggatgagcggcacggggacgtggtggtggtgcggcccatgcgggaccacaccctgaaggaggtcgctttctacaaccgcctgttctccgttccttctgtcttcacaccagccgtcgacaccaaggcccctgaaaaggccagcatccaccggctgatggaggccttcatcctcaggctgcagacccagttcccctccactgtcagcactgtgtacaggacaagtgagaagctggtgaagggcccccgggatggccctgctgctggcgactccggcccccgctgcctcctctgcatgtgtgccctggacgtcgacgccgctgacagtgccacggcttttggggctcagacctcctcgcgtctctcccagatgcagtcacccatccccctgactgagacccggacacccccggggccctgctgttctccaggggtgggctgggcccagcgctgtggccagggggcctgcaggagggaggacccccaagcctgcattgaggagcagctgtgctacagctgccgcgtgaacatgaaggacttgccctcactggaccccctgccgccgtacatcctggctgaggcccagctccgcacacagagggcctggggcttgcaggagatccgggactgtctgattgaggacagtgacgacgaggcgggccagagctgagcgtgaggacgtgcttgccgggacagcaggcagtggccacctggtacaccacactggagccggaaggcaaggacgggggactggcctctgattgtccatttgtataaataaaacattttttaattaaaaaaaaaaa

SEQ ID NO: 152 - DNA, 1169 bp, Homo sapiens
  CDS (150)..(1079)
ccagtatagaggtgtgatagccaatgtagcattatttgacggagtggtttccaaaggagataaaattgtatctgcacatactcaaaagacatacgaagttaatgaagtaggagtcttgaatcctaatgagcagccaactcataaattgaatgtatcctctagaccaatctgaatataacaatctgaagagtgctatagaaaaactgactttaaatgattccagtgtgaccgttcatcgggatagtagccttgctctgggtgctggctggaggctaggatttcttggacttttgcacatggaagttttcaaccagcgactggagcaagaatataatgcttctgttattttaacaacccctactgttccatataaagctgtactgtcatcatcaaaattgataaaggaacatagagaaaaagaaattacaattatcaatcctgcacaattccccgataaatcaaaagtaacagaatatttggagccagttgttttgggcactattatcacaccagatgaatacactggaaaaataatgatgctttgcgaggctcgaagagcagttcagaagaatatgatatttattgatcaaaatagagttatgcttaaatatctctttcctttgaatgaaattgtggtagatttttatgactctttgaaatccctatcttctggatatgctagttttgattacgaagatgcaggctaccagactgcagaacttgtaaaaatggatattctactgaatggaaatactgtagaggagctagtaactgttgtacacaaagacaaagctcattcaattggcaaagccatatgtgaacggctgaaggattctcttcctaggcaactgtttgagatagcaattcaagctgctattggaagtaaaatcattgcaagagaaactgtgaaagcctataggaaaaacgttttggcaaaatgttatggtggtgatattacccgaaaaatgaagcttttgaagagacaagcagaagggaaaaaaaagctgaggaaaattggcaacgttgaagttccaaaagatgcttttataaaagttctgaaaacacaatcttctaaataattggtgggaaaacaaagaattttcattgcaatttgtaatatgctgacaacagaaagaaaattataaaatttgcttgttaaaaaaaaaaaa

SEQ ID NO: 153 - DNA, 4549 bp, Homo sapiens
  CDS (1)..(4041)
atggagagttgcggtcttgctgcatcttctgtaactccctgttcagtgactttacaacaccctagcttgaaatctgccaagagacgattccagccccttccgtccgccgcgctccgccgctgtcctccgccggcccgcgtgggaggacgatgggtcagcgcggaaaaagtgaatgagggcggcagcggtggcggcggtagccagcgcctgactcggcgggcccggagcaccgcccgcgtcccggcccccggcaccatggacgcgccgcgcgcctcggcggccaagcccccgaccgggaggaagatgaaggctcgtgctcccccacctcctggaaaggctgccactctgcatgtgcacagtgaccagaagcccccccacgatggggccctcgggtcgcagcagaacttggttcgcatgaaggaggcgctgagggccagcaccatggacgtcaccgtggtcctgcctagcgggctggagaagaggagcgtgctcaatgggagccatgcgatgatggacctactggttgaactttgccttcagaaccacctgaatccatcccaccatgcccttgaaattcggtcttcagaaacccaacaacctttgagttttaagccaaatactttgattgggaccctgaatgtgcatactgtgtttctgaaagaaaaagttcctgaagagaaggttaagcctggtccccctaaggtgcctgagaaatctgtgcgtttggtcgtgaattacctgcggacacaaaaagctgttgtgcgtgtgagccctgaggttcctctccagaatattctcccagtcatttgtgcaaagtgtgaggtcagcccagagcacgtggttctcctcagggacaacattgccggagaggagctggagctgtccaagtccctgaacgagctcgggataaaggagctctacgcgtgggacaacagaagagaaacctttaggaaatcatcacttggcaatgatgagacagataaagagaagaaaaaatttctgggatttttcaaagttaataaaagaagcaatagtaagggctgtttaacgacccccaactccccatccatgcactcacgttctcttacgctgggtccatccctctcgctgggcagcatctcaggggtgtccgtgaagtcggagatgaagaagcgccgagcccctcctcctccaggttcagggccacctgtgcaagacaaggcatcggaaaaggtatctcttgggtcacagattgatttacagaagaagaagcggcgagcgccagctccccctccaccacagccaccaccaccgagtcccctgatccccaaccgcactgaggataaggaggagaacaggaagagcacgatggtaagcctgcccctggggtctggcagccactgcagcccggatggagccccgcaggtgctgtcagaggcggaggagaccgtgtcagttggcagctgttttgcgtcggaggacacgaccgaggactcaggagtgatgagttccccctcagacatcgtctctctggactcgcagcaggacagcatgaaatacaaagacaagtgggccacagaccaggaagactgcagtgaccaggacctcgctggaaccccagacctgggtccccagaagagccccttgtgggagaagaatggctctgagaactcacatctgagaactgaaaaagctgtcacagcctcaaatgatgaagaagacctattaattgctggagagttccgtaaaacccttgcagaacttgatgaagacctggaagaaatggaagacagctatgaaacagacaccagctccctcaccagctccatccatggtgcatccaaccactgcccacaggatgccatgatccctcacggcgacacagatgcaatcccagtaacattcataggggaagtttcagatgatcctgtggattcggggttgttttccaatagaaacaacaatgctgggtctttcgactcggagggtgttgccagcaggagagcctccctggcgccacttcaagctgagcacagccagccccatgaaaaggcaagggaggaagtacctgccctgcaccccgcttcccatgacatcggaaaaggaatccgtgtggccttatctaacatctctaaagatgggaatctaatggaaacggcgcccagggtgacttcttttgcttcgaatcttcacacagacaacctaaatgcaaaagtgaaagacaaagtgtatggctgtgctgacggggagaggactcaagccacagagagagtgaattcccaaccggtgaatgaaaaggacagcaacgataaaaacgctgccttggcaccaacatcatggcaccaacgaggccaaaacccagggaaaagctacagacttaagcacggcctcacaacgtataaaatcattcctccaaagtcagagatgcgatgttacgacagagatgtgtccctctccaccggagccattaagattgacgagctggggaacttggtgagtcctcacgccaccggcatcaggatcatttccctgtcttcgtctgtgcctgaagcagaatctcagcccattgggaaagtcagagagttctggaggtgcaactctgtggaaaaacacctgggccgaccctcagagagctctgccaggggacccccctccacccctgtgcccacgcagacgcagaatccagagagcagactccaagcagaccccaagccaatatcgccccagcagaagtctgcccaccatgagggccggaaccccctaggggaggggagaaaccagccccccaccatgggcatgggtcacgtgagggtgccagcagctcacaccacagaagtcacatttctcaagcctcagagaagaacgtccagccagtatgtggcctctgccattgccaagcgcataggagccccaaaagtccatgctgatgtggtgaggccacacggttatgccgagaagggttatgcaggcaaggcgccagtgctggctgcaccacctgtcactgtgaaagatgacaggacatccagcccacactcagagacacaaggatggaaggatggtgcccagtggccctgtgtcactcctcccaacaaccacggggaagatttggcagggggagcccctcctaggggggaggtcattggcccacacaggaagttgtctactcaggacagacctgctgctatccacagaagctcctgtttctcactggttcagtcttcccagagggatcgtgtttctgtgggacagagctgtggtttcagtggaaagcaaagcacaagtagccaggaggccagctcagcatctgagcccagacgcgcacctgatggtacagacccaccccctccacacacatctgacactcaggcctgcagcagggagctggtcaatggctctgtgcgcgccccaggccacggcgagccttcccaccctccaggagggtctggcacagaaagccacattctcctagaaagagaggaaaagcccagtgtgttctctacagatggaaatgaaacagacagtatttggccacccagcatttttgggccgaagaaaaaattcaaacctgttgtccagagaccagtcccaaaagacacatccctgcactctgccctgatggaagccatccactctgcgggagggaaggacagactacgcaagacggcagaacacaccggggagggcaggccagcgaaactgtcctacacggaggcagagggcgaacgatctgcactgctggcagctatccgcggggcacagcgcacctgcagcctgaggaaggtggcatcctctgcttctgaggagctccagagcttccgagatgccgcactctctgcacagggctcggaaagtcctctgctagaagaccttggtcttctgtccccaccagccattcccccaccaccccctccaccctcccaggctctctctgcaccaaggacggcctccaggttcagcacgggcaccctcagcaacaccgcagacgcaaggcaagccttgatggacgccatccgctccggcacaggggctgcgagactgagaaaggtgcccttgctcgtgtgaatgaacagaggccagagaattgcagaaacccacctgtaatatgcccacaggcgtcactcaaggagtctgcatagccaggaacatcaagttttggtgttactttcttgtctacaggccaaaatgcgcacagttgattttcggtgtgttcctgtataacggcttgaaaggaaaggagaagatgctgtgtcgctgcgcagctcgtgtgccaaggaaatgtgttttgcctctgaatatcttaagttgctaataaacgattcttgttggcaggttaatgggactataaatgctggagcccagcactcacacttaattatatttatgggcaaagtaaaaagaatcatgccttagactgattttggacctttgagacttttaccacatacagatggatgaaactacttactgatttaagatcttttgaattttagaaaaaacatatgaatcagatggaacaatctgaatgtgatatgctccatgatgctgtgtgttttggtagtaaaaaaaaaaa

SEQ ID NO: 154 - DNA, 3352 bp, Homo sapiens
  CDS (35)..(1621)
gaagccaggaaacctcgacgcgaaagtagaatatatgaaactgctgcccaaaatcctggctcactctattgaacacaaccagcacattgaggagagcaggcagctgctgtcctatgctttgatacatccagccacttcgttagaagaccgtagtgctttagccatgtggctgaatcacttggaggaccgcacgtcgaccagctttggtggccagaaccgaggccgctcagactctgtggattatggacagacacactactatcaccaaagacagaactctgatgacaagctcaatgggtggcagaactctcgggattctgggatttgcatcaatgcctccaactggcaggacaaaagcatggggtgtgagaatggccatgtgcccctctactcctcctcatctgtccccaccacaatcaatacgattggaaccagcacaagtacaaatgttccagcctggctgaaaagcctccgcctgcacaaatatgccgcgcttttctcccagatgacctatgaggagatgatggccctcaccgagtgccagctggaggcgcagaatgttaccaaaggtgcaagacacaaaattgtcatcagtattcagaagctcaaagaaagacaaaatctcctgaagtctttggaaagggacatcatcgaggggggcagcctgcgcatcccgctccaggaactgcaccagatgatcctgactccgatcaaggcctacagctccccgagcaccacccccgaggctcgccgccgggagccccaggccccgcgtcagccctcactgatgggccccgagagccagagccccgactgcaaagatggggccgcagccactggcgccacggccaccccctcggccggggccagcggggggctccagccgcaccagctgagcagctgcgatggggagctggccgtcgcccccctgccagagggggacctccccgggcagttcacacgcgtcatggggaaagtgtgcacacagctcttggtctccagacctgatgaggaaaatataagttcctatttacagctcatagacaagtgtctaattcatgaggcatttacagagacacagaaaaaaagattgttgtcatggaaacagcaggtgcagaagctctttcggtctttccctcggaaaacccttctagacatatcaggatatcgacagcaaagaaatcgaggctttgggcaatccaactccctcccgacggctggctctgtgggcggtggcatgggcagacggaacccgcgccagtaccagatcccctctcggaacgtcccttccgcccgcctgggcctcttgggcaccagtggattcgtcagctccaaccagcgcaacaccacagctacccccaccatcatgaaacaaggaagacagaacctgtggtttgccaaccccgggggcagcaatagcatgccaagccgcacccacagctcagtccagaggacccgctcgctgcccgtgcacacttccccacagaacatgctgatgttccagcagccagaattccagcttcccgtgaccgaacctgacatcaacaacaggctggagtcgttgtgcctcagtatgaccgaacacgccctgggagacggggttgaccggacctccaccatctagaagctgaagatgagagtgaccgcgctggccgtgaaatcgactgctgcgggtccagtgtccgccatcttcagggttgcacagaatcctccaagatactttgcagccttttttccccctggtccctctcccgttttgattttgtgagagcgtaggtcatcctcgtaaacatatcagtagacctggggttggttattttgtcatttgtttctgtcatgggatggtttggtgtgtggggtggggaggggtctctagggaattatgagactgggaggggggtggagggaatgcaggtagctctctggatggaacggggacaggggaaagagtactgccatgaaagagataggagacacataagaggacagcagaagccctggccctggggaggcttctcggaaggcctggcttcacaggcaggccacagaaggatatcgcgggcacgtgcacccaaagcaagatagtggcttcccttttatatccaatctaatcctgattggatgtccctgaggcccctgctggaaacagccataggagagggcccatggcagtaggggaaagaaggaagaaattccctgcaacaaaacttcagctaaactttgatttgtgtattgtttacataataattttaaagggtacataatgtgtaaagagtttggatagaacctctcttcatactatggttttcgtaaaggatctgttgttgttacggattcatattttccctctatttttataagagcagcagagttgtcttctcaaaacggctgccaagctctgcttcttgggaagatggatgcagtcatgtaggcctgagctgtccgtctttcaccgttaggtgggaggagcgtatgggtggacttgaaggacatggacgtggctggaatgagcacagcattgggtgagcgcacaaggatgaggacatcatgtgatcagttatgggtttgctcgcagggcacccagagattctcaaagaatcctgcagcctctttctgtgctggatttgcttgtcacggagaggcctccctccctttccaccccacccatggggcattatcctgtcactcccagccttgctccacacacacacaggtgggtacaagttccactggaggagaaaaggcaaggatggactttttccccttgtgagaggtttgatacccagaaaatgagctcaaaacctttacattagggttgcttgtaggaactggagcctggaggctgcatctacttcacctgtcactgctgagggagaggaggggagaaaggcccagcaacagcgtacagaggggtcagtcagcaagtccagagagcacatgcagggagatgtttggcccacaccgcacagccccgccatctccagtgggcgatgaaagatgtaggaaaggttgatttcaagatggaaatgacagcgctatccgcacagtatgaattagggatttgctgtgttagttgatttatccatccacacagaggggaggaaaaagacactcgttacttggtgggagattgagaaactgtggtacctaccacaaagtaatagctctgtttatgaagggcaagaaaggctacatttcagaatttgacacagtggagggtattagaggaaatcaaagaggagttgtgtggaaaatcaggttgtgtaaatgaaggtatgaatgctcagccagaggcaagatcagggagatggtacaaggcctgtttgttacatggatgagtcgggtgcctggt

SEQ ID NO: 155 - DNA, 2350 bp, Homo sapiens
  CDS (552)..(1640)
ccccccccccaccccccggtcgggcgccgacggttccgtttccggagtggagggcacgccagggtgtctgaagctgagaccccgggctcgcagtcgccccatgaatttcgagttccgcaactgacgctactgggcggggcttcatggccagggcctcgctcaggcctaagtttccccacctgtgctcaatgcacaggtgcggtgccgcctccagggccggccgagaagagaggccgcacccgcacggggactgcatctcccagagcgccccgcgagcggccgagcggcgggactccatgccctagagtgccccgcgggcggccgggcggcgggactccatgtcctagagtgccccgcgggcggccgggcggcgggactccatgtcctagagtgccccgcgggcggccgggcggcgggactccatgtcctagagtgccccgcgggcggccgggcggcggccgccgcaaccgacaggtccgggactgggcgctgcggcctcgtccgcgcgccggggcgggggcctagctcgacagcttcccggcggctgcgcgatggacagccccgaggtgaccttcactctcgcctatctggtgttcgccgtgtgcttcgtgttcacgcccaacgagttccacgcggcggggctcacggtgcagaacctgctgtcgggctggctgggcagcgaggacgccgccttcgtgcccttccacttgcgccgcacggccgccacgctgttgtgccactcgctgctgccgctcggctactatgtgggcatgtgccttgcggcttcagaaaagcggctccacgccctcagccaggcccctgaggcctggcggctcttcctgctgctggccgtgaccctcccctccatcgcctgcatcctgatctactactggtcccgtgaccggtgggcctgccacccactggcgcgcaccctggccctctacgccctcccacagtctggctggcaggctgttgcctcctctgtcaacactgagttccggcggattgacaagtttgccaccggtgcaccaggtgcccgtgtgattgtgacagacacgtgggtgatgaaggtaaccacctaccgagtgcacgtggcccagcagcaggacgtgcacctgactgtgacggagtctcggcagcatgagctctcgccagactcgaacttgcccgtgcagctcctcaccatccgtgtggccagcaccaaccctgctgtgcaggcctttgacatctggctgaactccactgagtacggggagctctgcgagaagctccgggcacccatccgcagggcagcccatgtggtcatccaccagagcctgggcgacctgttcctggagacatttgcctccctggtagaggtcaacccggcctactcagtgcccagcagccaggagctggaggcctgcataggctgcatgcagacacgtgccagcgtgaagctggtgaagacctgccaggaggcagccacaggcgagtgccagcagtgttactgccgccccatgtggtgcctcacctgcatgggcaagtggttcgccagccgccaggaccccctgcgccctgacacctggctggccagccgcgtgccctgccccacctgccgcgcacgcttctgcatcctggatgtgtgcaccgtgcgctgagtgggctggggccttgaggtgactctgtgtctccccccaaagccacagggcagggaagggggtggctgggcctcctggctggcaaagggctctacttaaagcacatgatgtagagcaactcgcctctgccctgggtctgcagaaggctgaggacttttggttaaaagcaatcctcatgaaaacaccccaccctgcttggcagccagggtacaagtcctgggcacctcctctttgcctccctcctgcccctttcctgctggtgggggcagatcctgcacacacagacacagcgtctgcccccgagccattccctggagaccctgggtctaccccaggtggtcgtcatctgggccatttgccttacttctctggagcatacccaccctcagttacgtgccagacctggaccgcattctcctgccctgtcctggagctggcccctggctgcctggaggaccctgggtaggtcctgagggtgggatggagaagagggcactgctgtggtgtgggagcagtcctggggcttcctggtggctgtgaccagttgaggggctgttcctgggtggggtggcaatgggaggacaggtcagagcgccctcatttgtggggctgcccctccgggtttctcatcctgtccttggtgcctttttctgcccaacaagtccagggaaggccgaggtctcagactcctgggtagggggggggggtgg

SEQ ID NO: 156 - DNA, 1521 bp, Homo sapiens
  CDS (681)..(1499)
ggaattcccgggtcgacgatttcgtggagataccgaaggagatactctttagtattgggatcccagaaaccagtcctatatctggccagagggacactgggttgtggcatctctctagctgctacccagaaggaacagggccccctggggcctataggccttgcccctgaccctgggaacacccagctcaggcctgccccagtggccacaagtcagggaggccgcaaatttttaactagaaacattgatcattaatagggggttagaaagagttcaaactaagtctcactctgggacatagaccaattgtgcttcaggcctcctgcagagatgctgggtccccaagtctggtcttctgtgaggcaggggctaagcaggagcttgtccaggaatgtgggggtctgggcctcaggggaggggaagaaggtggacattgcgggtatctacccccctgtgaccacccccttcactgccactgcagaggtggactatgggaaactggaggagaatctgcacaaactgggcaccttccccttccgaggcttcgtggtccagggctccaatggcgagtttcctttcctgaccagcagtgagcgcctcgaggtggtgagccgtgtgcgccaggccatgcccaagaacaggctcctgctagctggctccggatgcgagtgtgagccagaatgccctgggccctgggggtgggtggatgtgcaggccacgcgtccggcttcgtggtccagggctccaatggcgagtttcctttcctgaccagcagtgagcgcctcgaggtggtgagccgtgtgcgccaggccatgcccatgaacaggctcctgctagctggctccggatgcgagtccactcaagccacagtggagatgaccgtcagcatggcccaggtcggggctgacgcggccatggtggtgaccccttgctactatcgtggccgcatgagcagtgcggccctcattcaccactacaccaaggttgctgatctctctccaatccctgtggtgctgtacagtgtcccagccaacacagggctggacctgcctgtggatgcagtggtcacgctttcccagcacccgaatattgtgggcatgaaggacagcggtggtgatgtgaccaggattgggctgattgttcacaagaccaggaagcaggattttcaggtgttggctggatcggctggctttctgatggccagctatgccttgggagctgtggggggcgtctgcgccctggccaatgtcctgggggctcaggtgtgccagctggagcgactgtgctgcacggggcaatgggaagatgcccagaaactgcagcaccgcctcattgagccaaacgctgcggtgacccggcgctttgggatcccagggctgaagaaaatcatggactggtttggctactatggaggcccctgccgcgcccccttgcaggagctgagccccgctgaggaggaggcactgcgcatggatttcaccagcaacggctggctctgagggcaggcagaacaacgacagc

SEQ ID NO: 157 - DNA, 1840 bp, Homo sapiens
  CDS (72)..(1550)
tttcgtaggcttctcaggctcccacagcaccctcagtcattcccccagccgtggagcgagtgcagccagtgatggcccctgacgtcccagcaaccccagtggcccctacagagtcacagacagtgctggatgccctgcagcagaggctgaacaagtaccgcgaggcgggcatccaggcccggagtggtggggacgagcgcaaggctcggatgcatgagcgcattgccaagcaatatcaagatgctattcgagcacaccgagcaggacggaaagtcaactttgctgaattgcctgttcctccaggatttccccccatccctggcctggagtccactatgggtgttgaggaggacgcagtggcagcgacattggcagctgcagagaaactggcctctgcagaggattcagccccggctgataaagacgaggacgagcctcctgggcacctgcagggtgagcccccagcacaggccccagtggccaagaaacctgcacggcccacagtcccttcatcccagcgcctgcctgagcccagggcctcaagttctaaggagtcaccgagtccatctgtgcgggagcagctggcactgctggaggcacggaaactgcagtatcagcgggcagccctgcaggccaagcgcagccaggacctggagcaggccaaagcctatctgcgggtagccaaatggcttgaggctcagatcatccaggcccgatctggcagacctgttgatctgtccaaggtgccttcgcccttgacggatgaggagggtgacttcatcctcatccaccatgaggacctgcgactctcccagaaggcggaggaggtgtatgcccagctgcaaaaaatgcttctggagcaacaagagaagtgcctgctgttctccaagcagttcatgcaccagggcaacgtggctgagaccacccgatttgagaagcttgctcaggaccgcaagaaacagctggagatcctgcagctggcccaggctcagggcctcgaccctcccacccaccactttgagttgaagacattccagactgtgaggatcttctcagaactcaacagcacagaaatgcatctgatcattgtccggggaatgaacctcccagcccctccaggggtgactcccgatgacctggatgcttttgtgcggtttgagtttcactaccctaactcggaccaggctcaaaaaagcaaaacagctgtggtgaagaacacaaactctccagaatttgatcaactcttcaaactaaacatcaaccgaaaccaccggggcttcaagagggtgatccagagcaaaggcatcaagtttgagatcttccacaaagggtccttcttcagaagcgacaagctggttggcacagcacacctgaaactggagcggctggagaatgagtgtgagatcagagaaattgtggaggtcctggatggaaggaagcccaccggggggaagctggaggtgaaggtgaggctgcgggagcctctgagtggccaggatgtgcagatggtcactgagaactggctggttctggagcccaggggcttgtgaggtgggcagctctctgggccttcagaacctttgccccctccttttactcaactaactactcaactcatatctggagagaaaacctaggagtttctcatctatgagaaagacctaccatgctgggtagggcttatgggctgagtttctgatgttcctcagtagaactgggaagagaaggtaaccttccaaggtttaactatctatctatctatctatcttcaggaaaccctttctaaaatctttgtgttttcactgcagtttagactgacttcttgtgctttgcacccctg

SEQ ID NO: 158 - DNA, 1987 bp, Homo sapiens
  CDS (420)..(1703)
gcgagcctctctggtcccgacgcgggtggcccgggtctcctcgactcctgaggaaagcccaccgggcggggcgggaggtgaagaggctggggaagtcagaggttaacctgggcgtcaggggacgttggagttgatccgtcagggtcccggggcggtctgggggcagtagagacggggcttgggcgcggggcctgagaggtcaggggtcagcaggagtgaggctggggcgtccaggtccgagaggtcaggggtcagctggagaggggctggggcgccggtttcccggaggtcaggggtcagaaggaacagggctgcagcgtcagggtccgagaggttaggggtcggcagaggcggagctggggcactgggggtcaggggtcggggatcagggcggggtcgggtgcactggtagcctgcgcatgggcctccagcttcgcgcgctgttgggagccttcggacggtggaccctgcgcctgggaccgcgtccgtcctgctcgccgcgcatggccgggaacgcggagccgccgcccgccggagccgcatgcccccaggaccggaggtcctgcagcggccgggccgggggcgaccgcgtctgggaggacggagaacatccggcgaagaagctcaagagcggtggcgacgaggagcggcgcgagaagccgcccaagcggaagatcgtgctgctcatggcctattcgggcaagggctaccacggcatgcagaggaatgtcgggtcctcacaattcaaaacaattgaagatgacttggtgtccgccctcgtccggtcaggctgtattcctgaaaatcatggtgaggacatgaggaaaatgtccttccagcgctgcgcccggacagacaagggtgtgtccgcagccggccaggtggtatccctgaaggtgtggctgattgacgacattctagaaaagatcaacagccaccttccctctcacattcggattctgggactgaagcgggtcacgggcgggtttaactccaagaacagatgtgatgccaggacctattgctacctgctgcccacgtttgcctttgcgcacaaggaccgggacgttcaggatgagacctaccgcctgagcgccgagacgctgcagcaggtcaacaggctcctggcctgctacaagggcacgcacaacttccacaatttcacctcgcagaaggggccgcaggatcccagtgcctgccgctacatcctggagatgtactgcgaggaaccctttgtgcgggagggcctggagtttgcggtgatcagggtgaagggccagagcttcatgatgcatcagatccggaagatggtcggcctggtggtggccattgtgaagggttatgcccctgagagcgtgctggagcgcagctggggcacagagaaggtggacgtgcccaaggcgcccggactcggcctggtcctggagagggtgcacttcgagaagtacaaccagcgctttggcaacgatgggctgcatgagccgctggactgggcgcaggaggaaggaaaggtcgcagccttcaaggaggagcacatctaccccaccatcatcggcaccgagcgggacgaacgctccatggcccagtggctgagcaccttgcccatccacaacttcagtgccaccgctctcacggcaggtggcacgggcgccaaggtgcccagtcccctggaaggcagtgaaggggacggagacactgactgaggcgatgggagctgcccaccagagtgcctctgagcagctcacagtgtgtgcccagatgtgccacccctgtgggcagcaagaagctgggatcgctgcagccatgttttcccggccatgccggcgttgtaacctcaggaccttcccttgtaggaacagcctttctcgaatctgttttcagctcttgcattgcatagatgaacctcagcatgtaaagaactatttttttaaagaagtgattttcttattaaacaagtacaaattttgcttagtcaaaaaaaaaaaaa

SEQ ID NO: 159 - DNA, 2044 bp, Homo sapiens
  CDS (67)..(1962)
ggaaaagggacttgcaaaggacacagagcaagcggtttcagctgtactctgctaatgtaacagggaatgactcaaatggtatctaaaaagccaaggaaatgtgatttgactcccttcctggttttgaaagcaagaaagaaacaaaagttcacctctgcgaagggccccactctttctgagatctacatggttggaagtaaactttcggttcagatccagaagccaccttccaatatcaagaactccagaatgacccaagtctttcataagaacaccagtgttacttcactcccctttgtggacaccaaggggaagaagaatacggtaagcttcccacacattagcaagaaagtcctgctgaagtcatccctgctgtatcaggagaatcaagctcacaatcagatgccggcctcagagctcaaggcttcagaaatacctttccaccctagcattaaaacccaggatcccaaggcagaggagaagtcaccaaagaagcaaaaggtgactctgacagcggcagaggccctaaagctttttaagaaccagctgtctccatatgaacaaagtgaaatcctgggctacgcggagctgtggttcctgggtcttgaagccaagaagctcgacacggctcctgagaaatttagcaagacgagttttgatgatgagcatggcttctatctgaaggtcctgcatgatcacattgcctaccgctatgaagttctggagacaatcgggaaggggtcctttggacaggtggccaagtgcttggatcacaaaaacaatgagctggtggccctgaaaatcatcaggaacaagaagaggtttcaccagcaggccctgatggagctgaagatcctggaagctctcagaaagaaggacaaagacaacacctacaatgtggtgcatatgaaggactttttctactttcgcaatcacttctgcatcacctttgagctcctgggaatcaacttgtatgagttgatgaagaataacaactttcaaggcttcagtctgtccatagttcggcgcttcactctctctgttttgaagtgcttgcagatgctttcggtagagaaaatcattcactgtgatctcaagcccgaaaatatagtgctataccaaaagggccaagcctctgttaaagtcattgactttggatcaagctgttatgaacaccagaaagtatacacgtacatccaaagccggttctaccgatccccagaagtgatcctgggccacccctacgacgtggccattgacatgtggagcctgggctgcatcacggcggagttgtacacgggctaccccctgttccccggggagaatgaggtggagcagctggcctgcatcatggaggtgctgggtctgccgccagccggcttcattcagacagcctccaggagacagacattctttgattccaaaggttttcctaaaaatataaccaacaacagggggaaaaaaagatacccagattccaaggacctcacgatggtgctgaaaacctatgacaccagcttcctggactttctcagaaggtgtttggtatgggaaccttctcttcgcatgaccccggaccaggccctcaagcatgcttggattcatcagtctcggaacctcaagccacagcccaggccccagaccctgaggaaatccaattcctttttcccctctgagacaaggaaggacaaggttcaaggctgtcatcactcgagcagaaaagatgagatcaccaaagagactacagagaaaacaaaagatagccccacgaagcatgttcagcattcaggtgatcagcaggactgtctccagcacggagctgacactgttcagctgcctcaactggtagacgctcccaagaagtcagaggcagctgtcggggcggaggtgtccatgacctccccaggacagagcaaaaacttctccctcaagaacacaaacgttttaccccctattgtatgacctttgctgagggtatgtcctgctcctttccaccagtgatttgtattaagacagcacttatattgtacaatacttcagactg

SEQ ID NO: 160 - DNA, 1301 bp, Homo sapiens
  CDS (80)..(1036)
tttcgtgctgccgcaggttccaccgcgctccaggtatttttttttctgaaggaaagctgcttcctcatatgtttcaagaatggctctccctatcattgtaaaatggggtggacaggagtattcagtgaccacactttcagaagatgatactgtgctcgatctcaaacagtttctcaagacccttacaggagttcttccagaacgccaaaagttacttggactcaaagttaaaggcaaacctgcagaaaatgatgttaagcttggagctctcaaactgaaaccaaatactaaaatcatgatgatgggaactcgtgaggagagcttggaagatgtcttaggtccaccccctgacaatgatgatgttgttaatgactttgatattgaagatgaagtagttgaagtagaaaatagggaagaaaacctactgaaaatttctcgcagagtgaaagagtacaaagtggaaattttgaatcctcccagggaagggaaaaagcttttggtgctagatgttgattatacattatttgaccacaggtcttgtgcagagactggggtagaattaatgcggccatatcttcatgaatttctaacatctgcctatgaagattatgacattgttatttggtctgcaacaaatatgaagtggattgaagctaaaatgaaagagctgggagtgagcacaaatgcaaattataagattactttcatgttggatagtgctgctatgataacagtacatactccaaggagaggattaatagacgtaaagcctcttggtgttatatggggaaagttttcggagttttacagcaagaaaaacaccattatgtttgatgacatagggagaaattttctaatgaacccacagaatggactaaagataaggccttttatgaaagcgcacctaaatcgtgataaagacaaagaacttttaaaattaactcagtacctcaaggagatagcaaaattagatgactttttggatctaaatcacaaatattgggaaagatatctctcaaagaagcaaggacagtagttacaagttatactggcagttattgaagatacttaagatccaagaacttcttgcttttatgctagaaatcattatgatagtgctggacactgaagcaaataccatactgcttatacttggtcttccagttttttgtaaatttaattttatattttttgaagatgatagcaatatgctaaaaaatgcttgtcccctatatgaatattctgttacgcttgaaaaatattttctccagcgttggttactgaccaccccaccctcccac

SEQ ID NO: 161 - DNA, 2714 bp, Homo sapiens
  CDS (928)..(1785)
acccccttcccagaccctggcccgcagccggatcactccgggcgcgctgccgatcacgtggcgaagcggtgctccccagcgccgtggctgcgcgcccattggtcggcggctggagtcccgggcgcgcccattggcggggctggaacactctaggtagctggccccagggagctgttgcttcagcgtggagagggcgatccagggaccgcagctgggaagcgcctcccgggcccacgtgctccaccgcgctgctgggcccggctgcgaccgtgacccgggagctgcggctgcggcggctgatccctttaccacctgttgttctggcttcgaaactagcacaagttcccagccccgggtcccgagaggtctggagacttctccaaagttgggtagtggggtttggagcttaaggacaagccgcttcgtctctctccgggccttattttccctataaaacgcgaggaaatacacttggtaggctctcaggccaccgagggcgacgggacctagcacgatccccgtcccgggctggcggaggccaggcggccgcgcgggggtgctggtgtcgcgctgcttgctccggccggggttgcccctttgccggccccgcccgggtgcgataacgggctcctcctcctcgtcgtcttcctcccaccgccgacatctccgggaacccagcccaggccctgcctcccggacacaccgacgctcacgtagtcgcgcttgccacaaccctgcgggctctccgatgcggcgagcgagcttgcacatctcagttgctaggagtacttctgcatggcggcagccatccctgtcactcacgtagtcgcgcttgccacaaccctgcgggctctccgatgcggcgagcgagctggggagggggcttctccgcggcccaaaagggttctagcctgttcatctagccccatgatggctgtggacatcgagtacagatacaactgcatggctccttccttgcgccaagagaggtttgcctttaagatctcaccaaagcccagcaaaccactgaggccttgtattcagctgagcagcaagaatgaagccagtggaatggtggccccggctgtccaggagaagaaggtgaaaaagcgggtgtccttcgcagacaaccaggggctggccctgacaatggtcaaagtgttctcggaattcgatgacccgctagatatgccattcaacatcaccgagctcctagacaacattgtgagcttgacgacagcagagagcgagagctttgttctggatttttcccagccctctgcagattacttagactttagaaatcgacttcaggccgaccacgtctgccttgagaactgtgtgctcaaggacaaggccattgcaggcactgtgaaggttcagaacctcgcatttgagaagaccgtgaaaataaggatgacgttcgacacctggaagagctacacagactttccttgtcagtacgtgaaggacacttatgccggttcagacagggacacgttctccttcgacatcagcttgcccgagaagattcagtcttatgaaagaatggagtttgctgtgtactacgagtgcaatggacagacgtactgggacagcaacagaggcaagaactataggatcatccgggctgagttaaaatctacccagggaatgaccaagccccacagtggaccggatttgggaatatcctttgaccagttcggaagccctcggtgttcctatggtctgtttccagagtggccaagttacttaggatatgaaaagctagggccctactactagtgactgcaggtgacagggcgtggcggagctgccacagacacacctagctctgctcactgtgcagtggagatggaaggccagggaggagcaacgtggaacttccatgaggccccgtttgggaaaataaaaggatcctcttcacttctttcttaaacagcaaatccagccaggttcagattacacaaccagtgtctcactcaaaggagcagtggtggctggcgcgctttcgcactgtggcagccacgagagtctgtgcacgtctgtgctggaaagggtatggatgggaatcaagcctatgccagtgctgatgaagctggaggagtctctcctctgctctccactcagatgtgggacatcagtcgccaaaagccactcagccccagccacctcgcgtgagaccctcactgttcattgtgttcatctttgggtgctctctgccagccaggcctttcctgcaagctgctgtgcttccccgtccacgtgtatctctgctgtgacacactgacctgacgcacatttccagtgcagctgcagaagagaaatgggattggctcttgttttctgcaagttcatgttttgcattttatgttcttccacaattgatctgatgttcaggaaaagataataaaggcaaattagttagtggttgagacaggcatttcctcctcccgcttcttgaccccacagatgtattccagcagagagcaacacaccagtcatcaaaacccactggctcctgtgcggtgtcacagattgcagggttctgacaaggcaggacagtcaagagtggggacactttcagcttctacttttgccttctagggggagctttctaagtccccacatttaccccgagtcaccggaaaaatctgatttttcccccgaaagctcaatgactttaacgtgcttggctggtttgtctcattctt

SEQ ID NO: 162 - DNA, 1701 bp, Homo sapiens
  CDS (40)..(1530)
gtggagctgcggctgcccatctccgagacgctctcccagatgaaccgggaccagctgcagaagttcgtgcagtacctcatcagcgcccatcacactgaggtgctgcccactgctcagcgcttggctgatgagatcctcctgctgggctccgagatcaacttggtgaatggagtcgtggagtgggttcggccacgtggaatccgcgtcctgggaacccgtggaatccgcgtcctgggaacccgtggaatccgcgtcctgggaacccgtggaatccgcgtcctgggaacccgtggaatccgcgtcctgggaacccgtggaatccgcgtcctgggaacccgtggaatccgcgtcctgggaacccgtggaatcgggttggatgcgcatctccctctgagttgcgctgggcttggctgctgcaccatgaccctggaggcgatccgctactcgcggggctccctgcagatcctagaccagctgctgctgcccaagcagagccgctacgaggcggtgggctcggtgcaccaggcctgggaggccatccgcgccatgaaggtgcggggcgccccggccatagccctggtgggctgtctcagcctcgccgtggagctgcaggcgggcgccgggggaccgggactcgccgcgctcgtggccttcgtgcgcgacaagctgagcttcctcgtcaccgcccggcccaccgctgtcaacatggcccgcgccgcccgcgacctggctgatgttgcagcccgggaggccgaacgggagggcgctacggaagaggcggtccgggagagagtgatctgctgcaccgaggacatgctggagaaagacctcagagacaaccgaagcattggggacctaggagcccgccacctcctggagcgggtggcccccagcggtggcaaggtgactgtgctgacccactgtaacactggtgctctggccaccgctggctatggtacagccctaggtgtgattcgctcactgcacagcctgggccgcctggagcatgccttctgcacagagacccggccctacaaccagggagcccggctgacggcctttgagctggtctatgagcagatccccgccacccttatcaccgacagcatggtggctgctgccatggcccataggggcgtgtcagctgtggtcgtgggagctgaccgcgtggttgccaacggcgacacagccaacaaggtgggcacctaccagctggccattgtcgccaagcaccatggcattcccttctacgtggctgcccccagctcttcatgtgacctccgtctggagaccggcaaggagatcattattgaagagcgaccgggccaggagctgaccgatgttaatggggtccggattgcagcacctgggattggagtttggaatcctgccttcgatgtcaccccccacgacctcatcactggtggcatcatcacagaactgggggtctttgcccctgaggagctccggacagccctaaccaccaccatctcttccagggatggaaccctagatggaccccagatgtaaccaactcagctctccctagcctgcctctctaggtttttcaatacatttcttgaatggctacccaaaagctgaccgtccagcccctgaccacacttgttcctagtgcagggagctcagacagggccttccatctagagcccagcacctagagccaggctgcccagattcaaa

SEQ ID NO: 163 - DNA, 7543 bp, Homo sapiens
  CDS (109)..(6474)
caccctaactctatgattcctgcttttgaccaaaggaatgggttacgtgttatctacaaacttctggcatcgaaaagtgaaggaatcagggtacaagctcttaaggcaatgggttattttttaaaacatctggccccaaagaggaaagcagaagtcatgcttggacatggattgttttcattgctagctgaaaggctcatgcttcagacaaatttaatcacaatgaccacatataatgtgctgtttgagattcttatagaacagattggtactcaggtgatacataaacagcatccagatcctgattcttcagtgaagatacaaaaccctcagatactaaaagtaattgcgaccctacttcgaaattctccccagtgcccagagagcatggaggttcgcagagcctttctttctgacatgattaaactttttaataacagtagagaaaacaggaggagcttgctacaatgctctgtgtggcaagaatggatgctttctctctgctattttaatcctaagaattcagatgagcaaaagataacagaaatggtatacgccatattcagaatcctgctttaccatgcagtcaaatatgagtggggtggctggcgtgtatgggtagacactttatcaatcactcattcaaaggtcacttttgaaatacacaaagaaaaccttgccaatatatttagggaacagcaaggaaaagttgatgaagaaatagggctgtgttcttcaacttcagttcaagcagcttctggcattagaagggatattaatgtttcagtaggatcccagcaaccagatacgaaggattctcctgtctgtcctcatttcaccacaaatggtaatgaaaattcaagtatagagaagacaagttcactagaatctgcatctaatattgaactgcaaactactaatacatcttatgaagaaatgaaagctgagcaagaaaatcaggagttaccagatgaaggcactttggaagaaacactgacaaatgagacaaggaatgcagatgatttagaagtatcttctgacataatagaagctgtggctatttcctctaattcttttataacaactggcaaagattcaatgactgtcagtgaagtaactgcttctataagttctccttcagaagaggatgcctcagagatgccagaattcttggataaatctatagtagaggaagaggaagatgatgattatgtggaactgaaagtagaaggcagtcctactgaggaagctaatctacccacagagctccaagataacagtttgtctccagctgcatctgaagccggtgaaaaactggacatgtttggtaatgatgacaaattaatatttcaagaaggaaaacctgttactgaaaagcaaactgatactgaaactcaagattctaaagattctggaattcagactatgacagcatcagggtcttcagctatgtcaccagaaactactgtttcccaaatagctgtagaatcagaccttggtcagatgctggaggaagggaagaaagcaactaacctcactagagaaaccaaattaattaatgattgtcatggtagtgtctctgaggcttcttctgagcaaaagattgcgaagttggatgtttccaatgttgctacagatactgagaggctggagttgaaggccagtcccaacgtggaagcacctcaacctcatcgacatgtgcttgagatatcaaggcaacatgagcagccagggcaaggaatagcaccagatgcagttaatggacaaaggagggattccagatctactgtgtttcgtattcctgagttcaactggtctcagatgcatcaacgtttgctcactgatctattattttcaatagaaacagatatacagatgtggagaagccattcaacaaagacagttatggacttcgtgaatagcagtgataatgtcatctttgtacacaacacaattcatctcatctctcaagtgatggacaatatggtcatggcttgtgggggtatactgccattgctttcagctgctacatcggctacacatgagctggaaaatattgaacctactcaaggcctttcaatagaagcctctgtgacatttttgcagaggctaattagccttgtggatgtgcttatatttgcaagttctcttggctttactgaaattgaagctgaaaaaagtatgtcatctggaggaattttgcggcagtgtctccgactagtttgtgcagtcgcagtaaggaattgcttggagtgtcaacagcattcacaactgaaaactaggggagataaagccttgaaaccaatgcatagccttattcctttagggaaatctgcagcgaagagcccagtggacattgtgactggcggtatatctccagtaagagatcttgacaggcttctacaggacatggatattaatcggcttagggcagttgttttcagagacatagaggatagcaaacaagctcaatttttagccttggcagtagtatactttatctctgttcttatggtctccaagtacagagacattttggaaccccaaaatgaaaggcatagccagtcatgtacagaaactggcagtgaaaatgagaatgtatcactttctgaaatcacaccagcagcattcagcactttaactacggcatcagtggaagaatctgaaagcacatcatctgctcgaaggagggactcaggcattggggaagaaacagccactggtttaggaagccatgtggaagtaactcctcacacagcacctcctggtgtcagtgcaggcccagatgcaatcagcgaggtgctatctactctttctttagaagtcaataagtctccggaaaccaaaaatgatagaggaaatgacttggacactaaggctacaccgtcagtttcagtttcaaaaaacgtcaatgtgaaagacattctccgaagcttggttaacataccagcagatggagtcacagtggatcctgcccttctgccaccagcctgccttggagcccttggtgatctatctgtggaacaacccgtgcagttcagatcttttgacagaagtgtcattgttgcagcaaaaaagtcagcagtctcaccttccacctttaatacaagcatacctaccaatgctgtcagtgtggtttcctcagtagattcagcccaagcctcagatatgggaggagaatcaccaggcagtagatcatctaatgcaaaattgccctcagttccaacagttgattcagtttcacaagatccggtttcaaatatgagtattacagagaggcttgaacacgctttggaaaaggcagctcctctccttcgtgagatttttgtggattttgcaccttttctttctcggacacttttgggtagccatggacaagaactgcttatagaaggaacaagtctggtttgcatgaagtcgagtagttcagtcgtggaattggttatgctactgtgttctcaggagtggcaaaattctattcagaagaatgcaggccttgcttttatcgaacttgtcaatgaaggaaggttgcttagccagacaatgaaggatcatctagtaagagtagcaaatgaagctgaatttatcctgagcaggcagagagcagaagatattcacagacatgcggaatttgagtcactgtgtgcccagtattctgcagacaaacgagaagatgagaagatgtgtgatcatttgataagagcagcaaaatatcgtgaccacgtgacagcaactcaactaatccagaaaattatcaacattctcacagacaagcatggagcctggggaaattctgcagtgagtcgtcctcttgagttctggcgccttgactactgggaagatgacttgcggcgccggcgacgatttgtgcgtaaccctctaggatcgacacatcctgaagcgacactaaaaacagccgtggaacatgtgtgcatttttaaattgagagagaacagcaaagccacagatgaagatatccttgctaaaggaaaacagtccatcaggagtcaggctttaggaaatcagaactcagaaaacgagatcctcctggaaggcgatgatgatactctgtcatccgtggatgagaaagatttagagaatcttgccggtcctgttagcctgagcacaccagctcagcttgtggccccctctgttgtagtaaagggcactctttctgtcacctcctccgaactctattttgaggtggatgaagaggatcctaacttcaaaaaaatcgaccccaagatcttggcatatacagaagggctgcatggaaaatggctgttcacagagatacgatcaatcttttctcgtcgttatcttttgcaaaatacagccctggagatctttatggcaaacagagttgctgtgatgttcaacttcccagaccctgcaacagtaaagaaagtggttaactttctacctcgtgttggcgttggaacaagttttggattgcctcaaaccagacgtatttcattagctagtccacgtcagctttttaaggcttctaatatgacccagcgatggcaacacagagagatatctaattttgagtacttgatgtttctcaacacgatagcaggacggagttataatgacttaaatcagtatccagtgtttccttgggtcatcactaattatgaatcagaagaactggatcttaccttgcccaccaacttcagagatttgtccaagccaataggagctctgaacccaaaaagagcagcattcttcgctgagcgttatgaatcatgggaagatgatcaagttccaaagtttcactatggtactcattactcaactgcaagttttgttcttgcatggctgctaagaatagaaccctttacaacttatttcctaaatttgcaaggaggcaaatttgatcatgcagatcgaactttttcatcaatttccagagcttggcgaaacagtcagcgtgatacctctgatattaaggagttgatccctgaattttattatctccctgagatgtttgtcaacttcaataattataatcttggagtgatggatgatgggacagtagtgtctgatgtcgaacttcctccttgggccaaaacctcagaagaatttgttcacataaacagattggccctggagagtgaatttgtttcctgccagcttcaccaatggattgatctcatttttggctataaacagcaaggaccagaagctgtccgagccctcaatgtgttctattacttgacctatgaaggagctgtcaatctgaattcaataactgatcctgtgttgagagaggctgttgaagctcaaatccgaagttttggacagactccttctcaactactcatagagccccatcctcccagaggttctgccatgcaagtgagtccattgatgttcacagacaaagcccagcaggatgttatcatggtcctcaagtttccctccaactcccctgttactcacgtggcagccaacacccagcctggtttggcaactcccgctgtgatcacagtcactgctaacaggttatttgcggtgaacaaatggcacaaccttcctgctcatcaaggtgctgtacaagaccagccataccagctgccagtggaaatcgatcctctcatagccagcaatacaggaatgcacaggaggcaaatcactgaccttttagaccaaagtattcaagtgcattcccagtgctttgtcatcacttcagacaaccgctatattctcgtctgtggcttctgggataaaagtttcagagtctattctacagacacaggaagattgatccaagtggtgtttggccattgggatgtcgtcacttgccttgctcgttctgagtcatatattgggggaaattgctacattctctcagggtcacgtgatgcaactcttttgctgtggtattggaatggaaaatgcagtgggattggagataacccaggcagtgagactgctgctcctcgggccattttgaccggccatgactatgaggtcacatgtgctgcggtgtgtgcggagctaggcctggtgttgagtggttcacaagaaggaccatgtctcatacattccatgaatggagacttgttgaggaccttggagggtcctgaaaactgcctgaaaccaaaactcattcaggcttcaagagagggtcattgtgtcatattctatgaaaacggcctcttctgtacattcagtgtgaatggaaaactccaggccacgatggaaacagatgataacataagagccatccagctgagccgagatgggcagtacctgctcacaggaggagacagaggagtggtcgtggtccggcaggtgtcggacctcaagcagctctttgcctatccaggatgtgacgctggaatccgggccatggcgctgtcttacgaccagaggtgcatcatttctggcatggcttcaggaagcattgtgctattttacaacgactttaaccggtggcatcatgaataccaaacccgctactgatggtgacagctgtacatcaactctgcccctaggatgagcagaagtacctggagcatcattctcttctaccacatctgaatgtaacttaaatttgctcaaagaagcaaaatattttttaaagttattaataattgctatttttgtagtctttgcttgacttttttgggggggattagcaaagcagaaaactggctgctgggttctgtagttttaaaaaatctatatttttagtcataatgagaagtctattttcaccaattatggaaacatacagtggagcaagtaaaccacttattccagctataatattatgaagaacatttcccatgcatctacaagcttgagaaataggattttcacagtggggaagtgggttacaatattggaataggaaaatttgatgctgtaatttgggtcctgtatttttccaaacaactgtgcttcttcagcactaatatttctgggatttaaatagtaatgtttaaattatggtaaatgtaatttaaaacatctcaattaagtctgtctatcaatattgttcttcaagcatgttttagacctagaaaagtatggtttgggggaggctattttattgtgtggttagcacaaggaatctaatttatagcaagtgtgaaatagttaccattttttcctgatctgtcatcttcatagcacaacaaaacgaaatgatggaaatgctcttgagctcacaacatttgtttttcttttaaagtaaatgcaagtaccaaagctcactactgcggtttgcctgtgcctggacaatgaggcggagccactgttgttggggcacccccttccctccccgggtttgcaaatagaggctaccgggtgctgtattcagcaacacctgttttactatttgttattaaactatcatctccaccttccttttgattagcaatttgtactaagaaacgaaacaatgttatttggtggtgtataattctacttttctagtagattactgtgtggaattctgtgaaaaatatttgagaaaaggcctgtattgcataaataaattctttgtatgttgtgaaaaaaaaaaaaa

SEQ ID NO: 164 - DNA, 1721 bp, Homo sapiens
  CDS (267)..(1448)
acgccagcttggacgagggggtcctcgccaaggttcggaagaggaccttgaaaatggcttctgggcatgcgccacagcggccgttacgagacgcaaaaccgacgccttggaactgagagcctagagggacggagctcggcgcaccatgaggctcccggggcccaaggccgaccgtgagagcgcacgagctgagtcagtgctgattctctcaaatagagcttgaaggataaatcttcatttttgtttcaacaaaacttcgaaacaaaatggaagaaaataatctacagtgcagtagtgtggttgacggtaattttgaagaagttcccagggagacggcaattcagtttaaacctccactatacagacagcggtaccagttcgttaaaaatttagtggatcaacatgagcctaagaaggttgcagacctgggatgtggtgatacttcactcttaaggctgctaaaagtcaatccatgcattgaattgcttgttggagtagatattaatgaggataaattacgatggagaggggattcgttagctcctttcctgggggattttctgaaacctcgggatctgaatttgaccatcacattgtatcatggctccgttgtggagagagactctcgtttgcttggatttgacttgataacgtgtattgaattaatagaacatttggattcaggtgatctggccagatttcctgaagtggtatttgggtacctgtctccatccatgattgtcatcagcacaccaaactctgaattcaatcccctgtttccatcagtgaccttaagagattcagatcataaatttgagtggaccagaatggagtttcagacctgggctttatatgtggcaaatcgctatgattactctgtggagtttactggtgtcggggaaccaccagctggagctgagaatgttggatactgtacccagataggaatcttccggaaaaatggaggaaaggcaacagaatcatgtctttcagagcagcatgatcagcatgtttataaagctgtttttaccacctcatacccaagcttacagcaggaaaggttctttaaacttgtgttggttaatgaggtgtcccaacaagtggaaagcttaagagtgagccacctgccaaggcggaaagaacaggctggggaacggggtgataagcccaaagacattggtggctcaaaggcccctgtcccatgctttggaccagtcttcacagaggttgagaaggccaagatagagaactctcccacacccttctgtgttggagataaatttttcgtacctctgcagagactccttgcgtatcccaagttgaaccgcttatgtgctaatgaagagatgatgagatcagtcattgctgactcaattcctctgagcagtgatggttctgcagtggtggctgacctgcgtaattattttgatgaacagtttgagttttgaaccatgtttatttcctgaaatttcagggtctcagcgatagttgtgctcacttagaatttagttttttttgtgtaatcctaattcaagtaatgtttttaaagtttcactgcaaaagtctatgttccaagccattggacagacctgcttgagatatggccagactgcagtgagccctgagaaagatatgagggtttaaaacgggtgctttcctttgattttggacttttttgttttctcaagaataaagaagttggatgtggtaaaaaaaaaaaa

SEQ ID NO: 165 - DNA, 2886 bp, Homo sapiens
  CDS (403)..(1677)
  misc_feature (1)...(2886): n = a,t,c or g
ctttcatacatttttgtaagttatgtttccatgtctcgtgtgtgatgttgtgtactgttgacatgaaatactccttttttggtaaagatggattggcttaacagattagagctacagaaagtatgacttagcacgctggtaaggccacaaaaacccaagcaagttcccccagtttcgtatcctgtaaatagagataagttagtttttctgtttcagagagtggttatggaaaactactaggctttaaaatgattgttaatctcagtgtggggacatttggtttggggacatcagttcaggagtaaatgtatctgatcctgctttgaataaatgcaacttgaaagccttggaattttaccagatcgaatctgggccaaatagaaagcattttaagaaagaaagatggatcaacctagtggaagaagtttcatgcaagtattatgtgaaaaatatagtcctgaaaattttccttatcgccgtggcccggggatgggagtccatgtcccagccacacctcagggctctcctatgaaagatcgcctcaacctcccaagtgtactagtgttgaacagctgtggaataacctgtgcaggagatgaaaaagaaattgctgctttctgcgctcatgtgtcggaactagatctttctgacaacaaactcgaagactggcatgaggtcagtaaaattgtgtcaaatgttcctcagttggagtttctaaacctgagttccaaccctctgaatttgtcggttttagaaagaacatgtgctgggtccttctctggggttcgcaaacttgtcctcaacaacagcaaagcttcttgggagacggtccacatgatactacaggagttaccagatttggaggagctcttcctgtgccttaatgactatgaaacagtgtcttgtccttctatttgctgtcattctcttaagctactacatataacagacaataacctccaagactggactgaaatacgaaagttaggagttatgtttccttcactggataccctcgtcctggccaacaatcatttgaatgctattgaggagcctgatgattcattggccaggttgtttcctaatcttcgatccatcagcctccacaagtcaggtttgcagtcctgggaagacattgataaactaaattcatttcccaaactggaagaagtgagattgttaggaattcctcttctgcagccatataccaccgaggagcgaaggaaattggtaatagccagattgccatcagtttccaaacttaatggcagcgttgttactgatggtgaacgagaagattctgagagattttttattcgttactatgtggatgttccacaggaagaagtgccattcaggtatcatgaactgatcactaaatatgggaagttggagcctttggcagaagtggacctaagaccccagagcagtgcaaaagtagaagtccactttaacgatcaggtggaagaaatgagcattcgtctggaccaaacagtggcagaactaaagaaacagttaaaaactctagtacaattacccacaagcaacatgcttctctactattttgaccatgaagcaccctttggcccagaggaaatgaagtacagctctcgggcattgcattcctttggcattagggatggagataaaatttacgtggaatccaaaacaaaataacctctaccagccttgtgaaaaacatacacataaggacttgttgcagggcatttgtttttaatgtggttttctttaggagggagaggttgtttttgttttgttttgttctgtttaggtttgggaaggattttgtatatttttccccctggagtgagtaggggccatttttgggtgttttctaccacagattgatttggctcagccagcggaattggccacatttccagtgtatgtgccctctctaaggaaagatgacaaagaaatcaccgacttcttactgtgttcactgggatttgcctgccacttggttatcattactgttgggtgaacctgtgaagataacatgaacactgtagccccttagaagggtctcatagagaatttaaacagggtgacaaggaatcttcacaggaagggccagaacttctctctcccagttcttccttccgctaccctccctccttggcttttttggttcagttccatttttttttcattttgacatgtggtttacctaatagttttgttctgttcataattcttatttctcaacctgggtgatttttttgttctcatttctcccttttgaaataattgaaagtgttttaagcatttttaacctgattctaatctcaggtacgcagtaagaagctataactctgttagaacctcgaagagtagatgtagaatgaaaactccaggaaaacttgcagttattctggaagcaccggcagaacagtctgatctctttgtatgttactaactcacttttaatgtccctgtacattatgtcagccattactttcataacatgaaatatgtcagattccagagttcttttatttttgcttattgaatgtatttcctcatatctttctttttcattactttaaactattgggaattgaggcctgacttcataaataattcaatagagtcctggatacgtgcaccaggagagttgagaattagctcataaactatctgtggtgtgtgtggggaatgaagttgggggatgtgggggaagagcttatgactttcccacctgtgtcatccattggaagcccttgctcttgcactttgcattaaaagtgggaaacattaatcaaagggagattttattcccaggttttccctgggactttgtgatatcataattgaacagttcttttgttttncatttcaatttagttgcctcatagaagtata

SEQ ID NO: 166 - DNA, 4202 bp, Homo sapiens
  CDS (238)..(3441)
aagaaaaggctacatctaaacagcatcctatgggaccagtggcttcaatatcctgaacaaggggactccaacttctcttggactcttaagacccatgggttctggcagttggcctttttaggcaactcctataacagcagcatacccaggtgtctgtctgtaaccctcacagaaaagctactgctgacctttgaccctatccttgttgagaaggttgctattttgttataccatatcatgcaagataacccacagttaccccgcctttatctgagtggagtatttttctttatcatgatgtacacaggttccaatgtgcttcctgttgctcggcgcctgatgatagagaagattgctgcccatctcgcggatttcacacctcgtcttcagagtaacacaagagcactttatcagtattgccccattcctataatcaactatccacaactcgaaaatgaactattttgtaatatttattacctcaaacaactgtgtgatacactccggtttccagattggccaattaaagacccggttaagcttctaaaagatacccttgatgcctggaagaaagaagtagaaaagaagccacctatgatgtcaatagatgatgcttatgaagtgcttaatctgcctcaaggacagggaccgcatgatgagagcaagattaggaaagcttacttcagacttgcacaaaagtaccaccctgataagaatccagaagggagggacatgtttgaaaaagtaaataaagcatatgaatttttatgtaccaaatcagcaaaaatagtggatgggccagatccagagaatataattttaattctaaaaacacagagcatcctcttcaaccgtcataaagaagatttacagccttataaatatgcaggataccccatgcttattcggactataacaatggaaacttcagatgacctccttttctcaaaagaatcaccattgttgcctgcggctacagagctagctttccatactgtcaactgttcagccctcaatgctgaagagctcagaagagagaatggactagaggtgttacaagaggcatttagtcgctgtgtggctgtcttgactcgttctagtaaaccaagtgacatgtcagtacaggtgtgtggatacataagtaaatgctacagtgtggctgctcagtttgaggaatgccgagagaagatcacggaaatgcctagcatcatcaaggatctctgtcgggtactatattttggcaagagtattccccgcgtagctgctcttggggtagaatgtgtcagttcttttgctgtggatttctggctacagacacacctatttcaggctggaattttgtggtatctccttggttttctgtttaattatgactacacactagaagagagtggcattcagaaaagtgaagaaacaaaccagcaggaggtagcaaacagccttgccaaactgagtgtccatgctctgagtcgccttggagggtatttggctgaagaacaagcaactccagaaaatccaaccataaggaaaagcttagctggcatgctgacaccctatgttgctagaaaacttgctgtggctagtgtgactgagattttgaagatgcttaacagcaacacagaaagtccatatttgatatggaacaattctacaagagcagaattacttgaatttcttgaatcccaacaagaaaacatgattaaaaaaggtgattgtgacaaaacttatggatcagaatttgtctacagtgatcatgccaaagaacttattgtaggggagatttttgttagggtgtataatgaagttcctactttccaactggaggttccaaaagcatttgctgcaagtctcttggattatataggctcgcaggcccaatacttgcacacattcatggccatcacacacgcggcaaaagtggagtcagagcaacatggagatcgcttaccgagagtagaaatggctttggaggctctgagaaatgtcataaaatacaatccaggttctgagagtgaatgcattgggcactttaagttgatattttctcttctccgagttcatggagctggtcaagtgcagcagttggctttagaggttgtgaatatagtgacatctaaccaagactgtgtcaacaatattgctgaatcaatggttttgtccagtttattggctcttctacattcattgccatcaagtcgtcagcttgttctggaaactctttatgctttgacatcgagtacaaaaataatcaaagaagcaatggcaaagggtgctttgatctatttactggatatgttctgcaattcaacacatccacaggttcgagcccaaacagcagaactttttgccaaaatgacagcagataaactgataggtccaaaggttcgaattacgttaatgaaatttctaccaagcgttttcatggatgctatgagagacaatcctgaagctgctgtacatatttttgaaggaactcatgaaaatcctgagttaatttggaatgataattccagagataaagtgtccacaacagttagggaaatgatgctagagcactttaaaaatcagcaggacaaccctgaggcaaactggaagttgcctgaagattttgctgtggtgtttggagaagcagagggtgaacttgctgttggaggagtcttcttgaggatctttattgcacaaccagcctgggttctaagaaagcctagagaatttcttattgccctgttagaaaaattaactgagctcctagagaagaacaatcctcatggagaaactctggaaaccttgacaatggcaacagtgtgtctcttcagcgcacaacctcagctggcagatcaggtcccgccattgggccatcttcccaaagttatccaggcaatgaatcataggaacaatgccattcctaagagtgccattcgggttatccatgccttgtctgaaaatgagctgtgtgttcgagccatggcatctttagagaccattggcccactgatgaatggaatgaaaaagcgagcagatactgttggtctagcctgtgaagcaattaatcgaatgtttcagaaggagcagagtgaattagtagcacaagccctgaaagcagatttggttccatacctcttaaaattactcgaaggcattggccttgaaaacctggacagcccagcagccactaaggctcagattgttaaagctctcaaggcaatgactcgaagtttgcagtatggagaacaggtgaatgaaatcctgtgccgttcttcagtctggagtgccttcaaagatcagaaacatgatttgttcatttctgagtcacaaacagcaggatacctcacaggacctggagttgctggctaccttaccgcaggtacatctacatcagtcatgtctaacctgccacctcctgtagaccatgaggcaggcgaccttggctatcagacttgaaatattcacgagagacaataaacgctgaaaggccagtgccaagtccacattcctccagctgatacgttgaagcaaactcttactgcctttctcctggtttcatgacagtgttattcctttttctataaatatatttttaggaaaaaaagtcagtgatcctaattgtatcacattataagaaagcactctgtggatcaacataagtgggtacacaagaattttttttttcttggtgtatgtaagcacatttgttcctttatatctgtttacaaaactgtgaatcaaaaagacaaaactttcttcctagtttttgtaattttttttttgaactagcatgactgtagggttgagctacagtcaacaaaaattgggctaagtcacttttccccaggaaagaatatttccctctcctgcatcaagtctgcgtggccatcctccccccaccatccaagactattaggttttgtccctgcacccttcactggcatcctcaatcattaaccttctgaaagctcacagtacacattagtatgtataactggctttaccaaattgaatgaaaaggagcttgtgcaaaaaaatttaaaaatggatgtcaagatgttatgtaaaagatgagtataattgtgaaatgttctatacactatcaaatatataaagctttctatattgaatgtacattatacagatcattcatatgtgtacataaaattttaaaaataaagggaattgactgctttgttaatgagaaaaaaaaaaaa

SEQ ID NO: 167 - DNA, 953 bp, Homo sapiens
  CDS (304)..(801)
gggagctggaaatgcagctattgaggtcttcgaatgctgcggacgtggaggcggaggcagctggggaggtccgagcgatgtgaccaggccgccatcgctcgtctcttcctctctcctgccgcctcctgtctcgaaaataacttttttagtctaaaaaaagaaagacaaaagtagtcgtccgcccctcacgccctctcttcctctcagccttccgcccggtgaggaagcccggggtggctgctccgccgtcggggccgcgccgccgagccccggccgccccgggcgcccccgcacgccgcccccatgcatcccttctacacccgggccgccaccatgataggcgagatcgccgccgccgtgtccttcatctccaagtttctccgcaccaaggggctcacgagcgagcgacagctgcagaccttcagccagagcctgcaggagctgctggcagaacattataaacatcactggttcccagaaaagccatgcaagggatcgggttaccgttgtattcgcatcaaccataaaatggatcctctgattggacaggcagcacagcggattggactgagcagacaggagctgttcaggcttctcccaagtgaactcacactctgggttgacccctatgaagtgtccacaagaattggagatgatggctccatctgtgtgctgtatgaagcctcaccagcaggaggtagcactcaaaacagctccagcgtgcaaatggtagactgccgaatcagctgtaaggaggaacttctcttgggcagaacgagcccttccaaaactacaatatgatgactgtatcaggttaagatatagtctgtggatggatcatctgatgatgatggataaatttgatttttgctttgggtgggctcctcttggggatggattatggaatttaaaccatgtcacacgtttgaagaacctgctcaggttagaatggt

SEQ ID NO: 168 - DNA, 1943 bp, Homo sapiens
  CDS (1)..(1665)
atggagtcatggatgcttcattcctcagaactcttcccaaatatcttctgctatgcttccttatcaatggaaaaaggctgcggcatgtttaccttcctgtcatctgtcactgctgctgtcagtggcctcctggtgggttatgaacttgggatcatctctggggctcttcttcagatcaaaaccttattagccctgagctgccatgagcaggaaatggttgtgagctccctcgtcattggagccctccttgcctcactcaccggaggggtcctgatagacagatatggaagaaggacagcaatcatcttgtcatcctgcctgcttggactcggaagcttagtcttgatcctcagtttatcctacacggttcttatagtgggacgcattgccataggggtctccatctccctctcttccattgccacttgtgtttacatcgcagagattgctcctcaacacagaagaggccttcttgtgtcactgaatgagctgatgattgtcatcggcattctttctgcctatatttcaaattacgcatttgccaatgttttccatggctggaagtacatgtttggtcttgtgattcccttgggagttttgcaagcaattgcaatgtattttcttcctccaagccctcggtttctggtgatgaaaggacaagagggagctgctagcaaggttcttggaaggttaagagcactctcagatacaactgaggaactcactgtgatcaaatcctccctgaaagatgaatatcagtacagtttttgggatctgtttcgttcaaaagacaacatgcggacccgaataatgataggactaacactagtattttttgtacaaatcactggccaaccaaacatattgttctatgcatcaactgttttgaagtcagttggatttcaaagcaatgaggcagctagcctcgcctccactggggttggagtcgtcaaggtcattagcaccatccctgccactcttcttgtagaccatgtcggcagcaaaacattcctctgcattggctcctctgtgatggcagcttcgttggtgaccatgggcatcgtaaatctcaacatccacatgaacttcacccatatctgcagaagccacaattctatcaaccagtccttggatgagtctgtgatttatggaccaggaaacctgtcaaccaacaacaatactctcagagaccacttcaaagggatttcttcccatagcagaagctcactcatgcccctgagaaatgatgtggataagagaggggagacgacctcagcatccttgctaaatgctggattaagccacactgaataccagatagtcacagaccctggggacgtcccagcttttttgaaatggctgtccttagccagcttgcttgtttatgttgctgctttttcaattggtctaggaccaatgccctggctggtgctcagcgagatctttcctggtgggatcagaggacgagccatggctttaacttctagcatgaactggggcatcaatctcctcatctcgctgacatttttgactgtaactgatcttattggcctgccatgggtgtgctttatatatacaatcatgagtctagcatccctgcttttgttgttatgtttatacctgagacaaagggatgctctttggaacaaatatcaatggagctagcaaaagtgaactatgtgaaaaacaacatttgtttatgagtcatccaccaagaagaattagtgcccaaaaacaggctccagaaaagaagaccccaggagcagctcttggaggtgttaacaacgctgtgttggtagggggccatccaggcagtttctccagagactaaatggctcacaaccttctgaagtgggtgtgcccaaacccttcggggtgccttggaccaagctttttggaaccgggcccttcaggcctgcgccggtttgaggccctctagtaac

SEQ ID NO: 169 - DNA, 1977 bp, Homo sapiens
  CDS (1)..(1977)
atggagtcatggatgcttcattcctcagaactcttcccaaatatcttctgctatgcttccttatcaatggaaaaaggctgcggcatgtttaccttcctgtcatctgtcactgctgctgtcagtggcctcctggtgggttatgaacttgggatcatctctggggctcttcttcagatcaaaaccttattagccctgagctgccatgagcaggaaatggttgtgagctccctcgtcattggagccctccttgcctcactcaccggaggggtcctgatagacagatatggaagaaggacagcaatcatcttgtcatcctgcctgcttggactcggaagcttagtcttgatcctcagtttatcctacacggttcttatagtgggacgcattgccataggggtctccatctccctctcttccattgccacttgtgtttacatcgcagagattgctcctcaacacaaaaaaggccttcttgtgtcactgaatgagctgatgattgtcatcggcattctttctgcctatatttcaaattacgcatttgccaatgttttccatggctggaagtacatgtttggtcttgtgattcccttgggagttttgcaagcaattgcaatgtattttcttcctccaagccctcggtttctggtgatgaaaggacaagagggagctgctagcaaggttcttggaaggttaagagcactctcagatacaactgaggaactcactgtgatcaaatcctccctgaaagatgaatatcagtacagtttttgggatctgtttcgttcaaaagacaacatgcggacccgaataatgataggactaacactagtattttttgtacaaatcactggccaaccaaacatattgttctatgcatcaactgttttgaagtcagttggatttcaaagcaatgaggcagctagcctcgcctccactggggttggagtcgtcaaggtcattagcaccatccctgccactcttcttgtagaccatgtcggcagcaaaacattcctctgcattggctcctctgtgatggcagcttcgttggtgaccatgggcatcgtaaatctcaacatccacatgaacttcacccatatctgcagaagccacaattctatcaaccagtccttggatgagtctgtgatttatggaccaggaaacctgtcaaccaacaacaatactctcagagaccacttcaaagggatttcttcccatagcagaagctcactcatgcccctgagaaatgatgtggataagagaggggagacgacctcagcatccttgctaaatgctggattaagccacactgaataccagatagtcacagaccctggggacgtcccagcttttttgaaatggctgtccttagccagcttgcttgtttatgttgctgctttttcaattggtctaggaccaacagggcaggccggaggaaaagctggactcaaagcagagggaagcagagacgactcactgaatccggtagacaaactggaatccatgggaggaaactgcagcactcatgtctttcgccacatcactccagaggaacctgggcttgaaggtgaagaacagtgtggaatcagagtcctaattagttaccggctagactttgataagtcccttaagcacaaactaaatgagcaggaagaggcagcaaaaagcgtacaatgtatttgtgggaattgtaaatgtggaagtgaagaccagcctctgatttatcaaagatcattaaatgaattaaaacttttccaaatttcaccttcagaagagaaaaaagtgatcatggatccagtaaaagccatcgacttgccaagatgcatcacaagaagcaggatcctcaagattctgatgactctcatctgcaaacctagtttttcctctgaccgcttccagccaaagatacagtccctttgtagtcatggaccaagtcaaggcacattcagtggtcagcagtggcccccacagtgcacttga

SEQ ID NO: 170 - DNA, 2775 bp, Homo sapiens
  CDS (277)..(2064)
gcacgagctctctggagtcgattgccccgagacacatgggccaaggaggggtcagcggcgaattctttcggcctgttggggacccctcgtgtccccacgccagactggacctcccgtatgaacttctcttcgcatcggcggcggcttccgtcacctccgctcccccgatcctattcccagtcgtatgccagcttggagagtcacgtgagagcaagagagtagctttctggttgtcctggtgccctgctcaggcaaactgactgccattctctgaggatggcagctctgtcccccacatttgccacgtccacccaggattccacctgtctccaggactcagaatttcctgtttcttcaaaagaccattcctgtccccagaatttggacctgttcgtgtgcagtggtctggagcctcacacacccagtgttggttcccaggaatcggtgactttccaagatgtcgctgtggactttaccgagaaggagtggcccttgctggattcttctcagagaaaactgtacaaagatgtaatgctggagaactacagcaacctcacttcactggggtatcaggtcggcaaacccagcctcatctcacacttggagcaggaggaggagccgaggacagaggagaggggcgctcaccagggcgcttgtgcagattgggagactccatctaaaaccaagtggtcacttcttatggaagatatttttgggaaggaaacgcccagtggtgtgacgatggaaagagccggtcttggagagaagtccactgaatacgctcacttgttcgaagtctttggcatggaccctcatctcactcagccaatgggaaggcacgctggcaagaggccctatcaccgccgcgactatggggtagcgttcaagggcaggccgcacctcactcagcacatgagcatgtacgacgggagaaaaatgcatgaatgtcatcagtgccaaaaagccttcaccacgagcgcgtccctcacacggcacaggagaatccacaccggggagaagccttacgagtgcagcgactgcgggaaagccttcaacgacccttcagcccttaggagccacgcaagaactcacctcaaagagaagccctttgactgcagtcagtgtggaaatgcattccggaccctctcggccctgaaaatccacatgcgagttcacactggcgagaggccttacaagtgtgatcagtgcgggaaggcttacggccggagctgccacctcatcgcacacaagagaacgcacaccggagagaggccctacgagtgtcacgactgtgggaaagctttccagcacccctcccacctcaaagagcacgtgaggaatcacacgggggagaagccctacgcgtgcacgcagtgcggcaaagccttccgctggaagtccaactttaatttgcacaagaagaaccacatggtggagaagacctacgaatgtaaagaatgcgggaaatcctttggcgatctcgtgtcccggaggaaacacatgaggattcacatcgtcaagaaacccgtggaatgtcggcagtgcgggaagaccttccgaaaccagtccatccttaagactcacatgaactctcacactggagagaaaccatacgggtgcgatctctgcgggaaagctttcagcgcgagttcaaacctcaccgcacacaggaagatacacacgcaagagagacgctacgaatgcgccgcctgcgggaaagtcttcggtgactatttatcccggcggaggcacatgagcgttcaccttgtaaagaaacgagttgagtgtaggcagtgtggcaaggccttcaggaaccagtcaacgctgaagacgcacatgcgaagccacacgggggagaaaccgtacgaatgcgatcactgtgggaaggccttcagcataggctccaacctgaatgtgcacaggcggatccacaccggggagaagccctacgaatgccttgtctgcgggaaagccttcagcgaccactcatccctcaggagccacgtgaaaactcaccggggagagaagctctttgtgtcatccgtgtggaaaaggctccagtgagcgcgcctgctttagagacacaggatgattcagaccggaaacagacctcgtgggtgtaagaggaagcctctgtgagctcgcaccttactgggtgcaaaagaatccacggaacttgggagaagtccagttcctgtaaaaactgggaagacgaggcgttctcatcccataggaggtttgtgagaactcacgccgggggtgaaaatgtacgtctgtagcatggagaagccttcagggtacattcagctcttaacaaacacaggaggacttaatggcagcttggcatttaatgtcaaaatccaagccgtggcatttaatgtcaaaatgacttcagaccacttctagccttctgggcccatgagtaataatgagcacactagggagcatctctgtaaacacagtggctggggaaacccttcctagtctcacttgattcctcatgacggaaatcacactaaagagagaaatcagtgaagtaaggaacgtggaaggtcatgaatgggccgcaaaccacggccagctgcttgtctttgtatggcttgccagctaacaatagtggttccatctttaaggaagaagaatgtttgatggagaaaatttgtggccaatgaagtctgaaatacttcctgtcatctgcccctttccagaaaaacttggccgacccttggtctacagcacgggttctcagtcgggcgacgatttggctgtctaggc

SEQ ID NO: 171 - DNA, 2023 bp, Homo sapiens
  CDS (150)..(2009)
cggacgcgtgggtgtaaatccggctggactttcagcttctaagaacagtccgtttctcgaggatccaggcgcaggaggacagagcaatgggtgagagaactcttcacgctgcagtgcccacaccaggttatccagaatctgaatccatcatgatggcccccatttgtctagtggaaaaccaggaagagcagctgacagtgaattcaaaggcattagagattcttgacaagatttctcagcccgtggtggtggtggccattgtagggctataccgcacaggaaaatcctatctcatgaatcgtcttgcaggaaagcgcaatggcttccctctgggctccacggtgcagtctgaaactaagggcatctggatgtggtgtgtgccccacctctctaagccaaaccacaccctggtccttctggacaccgagggcctgggcgatgtagaaaagagtaaccctaagaatgactcgtggatctttgccctggctgtgcttctaagcagcagctttgtctataacagcgtgagcaccatcaaccaccaggccctggagcagctgcactatgtgactgagctagcagagctaatcagggcaaaatcctgccccagacctgatgaagctgaggactccagcgagtttgcgagtttctttccagactttatttggactgttcgggattttaccctggagctaaagttagatggaaaccccatcacagaagatgagtacctggagaatgccttgaagctgattccaggcaagaatcccaaaattcaaaattcaaacatgcctagagagtgtatcaggcatttcttccgaaaacggaagtgctttgtctttgaccggcctacaaatgacaagcaatatttaaatcatatggacgaagtgccagaagaaaatctggaaaggcatttccttatgcaatcagacaacttctgttcttatatcttcacccatgcaaagaccaagaccctgagagagggaatcattgtcactggaaagcggctggggactctggtggtgacttatgtagatgccatcaacagtggagcagtaccttgtctggagaatgcagtgacagcactggcccagcttgagaacccagcggctgtgcagagggcagccgaccactatagccagcagatggcccagcaactgaggctccccacagacacgctccaggagctgctggacgtgcatgcagcctgtgagagggaagccattgcagtcttcatggagcactccttcaaggatgaaaaccatgaattccagaagaagcttgtggacaccatagagaaaaagaagggagactttgtgctgcagaatgaagaggcatctgccaaatattgccaggctgagcttaagcggctttcagagcacctgacagaaagcattttgagaggaattttctctgttcctggaggacacaatctctacttagaagaaaagaaacaggttgagtgggactataagctagtgcccagaaaaggagttaaggcaaacgaggtcctccagaacttcctgcagtcacaggtggttgtagaggaatccatcctgcagtcagacaaagccctcactgctggagagaaggccatagcagcggagcgggccatgaaggaagcagctgagaaggaacaggagctgctaagagaaaaacagaaggagcagcagcaaatgatggaggctcaagagagaagcttccaggaatacatggcccaaatggagaagaagttggaggaggaaagggaaaaccttctcagagagcatgaaaggctgctaaaacacaagctgaaggtacaagaagaaatgcttaaggaagaatttcaaaagaaatctgagcagttaaataaagagattaatcaactgaaagaaaaaattgaaagcactaaaaatgaacagttaaggctcttaaagatccttgacatggctagcaacataatgattgtcactctacctggggcttccaagctacttggagtagggacaaaatatcttggctcacgtatttaagagcctgaatattc

SEQ ID NO: 172 - DNA, 1851 bp, Homo sapiens
  CDS (19)..(699)
gggagtcggcggcacaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagagaccgacctccgcgtggtgggctgcgagctcatccaggcggccggtatcctgctccgcctgccgcaggtggccatggctaccgggcaggtgttgttccagcggttcttttataccaagtccttcgtgaagcactccatggagcatgtgtcaatggcctgtgtccacctggcttccaagatagaagaggccccaagacgcatacgggacgtcatcaatgtgtttcaccgccttcgacagctgagagacaaaaagaagcccgtgcctctactactggatcaagattatgttaatttaaagaaccaaattataaaggcggaaagacgagttctcaaagagttgggtttctgcgtccatgtgaagcatcctcataagataatcgttatgtaccttcaggtgttagagtgtgagcgtaaccaacacctggtccagacctcatgggtagcctctgagggtaagtgactaagacttctcctctgctgtccaagcgctttggtgcagggacagcggcatcttcagccaatccagtgcaggctctccaccgaaggctggctctagactggtggtacgcacatagcatagccatggccgactcctgctgtggttctctgacgattgtgcttcttgttaatcctctgtcgtgctttggtaatcgtattgattagagttggtaactgtcttgacttgaattttgtccctttaaaactgctgtacctgtatgataaagatgcagtacctttctcttaaaaaaaaatgctatggaaagctgtgagaattgaagagacaaattggctgtgtcagtgtggggttatgtcatgatttctagaagccctgaagttgctcttttgagcagctttgcatgacacgctctggtaaaaggtgtgcatctttaaattatttcatggatactttgaaaaatattgtatcacttcaaatacagcaataagttatatggtctcaagatttcatttgtttttaagaattttaagttcgtggattaatatcactacttgaatactgacagttgttgattagacaccgaaaggttactgattgttgaatgtatctgtgttagagctgtgcactggcacgcttgcatcaggggctggggccacacggccgccacacagattcccccgtgatgcctggagctgcttccagagccgggtgtctccaagaggcacctgtaggacttcccatttagaaatctcttgagtgggtttgtatgttaccttctccaaggtttatttaggacagagatattgctggaaggtcatgggtcagattccctcacaacccacctcgtctgcgggtgcagccccactccaaggctccccgttattggggtatgtgaggagcagtaaatataaaaccagttcaactgtcctcatggaatcaccctttctgtttttgcagtattcataaagctagtgtaaggtctggttttagtctattaaatcttagagatctaaaggaaatgctcaaaatgtagccaggttttaaatgctttaacttttaaaaaatgtaaatttttgtatgtttatagcttctaaatatgaaagttaaagaatgtactgtgatgaaatgtcagtattatgttgcttctcagtatca

SEQ ID NO: 173 - DNA, 2303 bp, Homo sapiens
  CDS (81)..(2078)
cccattgcggtggaattccgtgagtcgctgcggggctgacggggtggcagtgcggcgggttacggcctggtcagaccataatgacttcagcaaataaagcaatcgaattacaactacaagtgaaacaaaatgcagaagaattacaagactttatgcgggatttagaaaactgggaaaaagacattaaacaaaaggatatggaactaagaagacagaatggtgttcctgaagagaatttacctcctattcgaaatgggaattttaggaaaaagaagaaaggcaaagctaaagagtcttccaaaaaaaccagagaggaaaacacaaaaaacaggataaaatcttatgattatgaggcatgggcaaaacttgatgtggaccgtatccttgatgagcttgacaaagacgatagtacccatgagtctctgtctcaagaatcagagtcggaagaagatgggattcatgtagattcacaaaaggctcttgttttaaaagaaaagggcaataaatacttcaaacaaggaaaatatgatgaagcaattgactgctacacaaaaggcatggatgccgatccatataatcccgtgttgccaacgaacagagcgtcagcatattttagactgaaaaaatttgctgttgctgagtctgattgtaatttagcagttgccttgaatagaagttatacaaaggcttattccagacgaggtgctgctcgatttgctttgcaaaaattagaagaggccaaaaaagattatgaaagagtattagaactagaaccaaataactttgaagcaacaaatgaactcaggaaaatcagtcaggctttagcatccaaagaaaactcatatccaaaggaagctgacatagtgattaagtcaacagaaggagagcgaaagcaaattgaagcacaacagaataagcagcaggccatttcagagaaagatcgggggaatggatttttcaaagaggggaaatatgaaagagcaattgaatgctatactcgagggatagcagcagatggtgctaatgcccttcttccagctaacagagctatggcctatctgaagattcagaaatatgaagaagctgaaaaagactgcacacaagccattttattagatggctcatattctaaagcttttgccagaagaggaactgcaagaacatttttgggaaagctaaatgaggcaaaacaagattttgaaactgttttacttctggaacctggaaataagcaagcagtaactgaactctccaaaattaaaaaggaattaattgagaaaggacactgggatgatgtctttcttgattccacacaaagacaaaatgtggtaaaacccattgataatccaccgcatcctggatcaactaaaccactcaagaaggttattattgaagaaactggtaatttgatacagactattgatgtgccagatagcactactgctgctgctccagagaataatcctattaatctagcaaatgtaatagcagccacaggcaccacaagtaagaagaattcaagccaagatgacctttttcccacaagtgatactccaagagcaaaagtattgaaaatagaagaagtcagtgatacttcatccctgcaacctcaagccagtttgaagcaggatgtatgtcagtcttacagcgagaaaatgcccatagagatagaacaaaaacctgctcagtttgccacaactgttcttcctccaattcctgcaaactcgttccagctcgaatctgatttcagacaattgaaaagttctccagatatgttgtatcagtatttaaagcaaattgaaccatctttgtatcctaagttgtttcagaaaaatctggatccagatgtattcaaccagatcgttaaaattctgcatgacttttacattgagaaagaaaagccattactcatctttgaaatcttacaaagactttctgaactaaaaaggtttgatatggcagtgatgtttatgtcagaaacagagaaaaagattgcacgtgcattatttaatcacatagacaagtcaggattgaaggatagttctgtcgaagaactcaagaaaagatacggtggttgatttccatttttgctgaaataattgtttttgactttcatatgtaaattttttctactgaaagtgttttgctttttaagaaaatgaaattatatagcaggaaaggactatctttgaacataagttaattaactataaggtgaattgtgatttaactagtgagaattgtattcaagtgaactctgtttttctgaaaataaaaatataaacaatgagaaaaaaaaaaaa

SEQ ID NO: 174 - DNA, 767 bp, Homo sapiens
  CDS (127)..(750)
tttcgtcacgagtgaccacggctagataggccgccggccagatgtggcgggggagagccggggctttgctccgggtgtgggggttttggccgacaggggttcccagaaggagaccgctaagctgcgatgctgcgtcgcaggcgggaagcaattatccccgctgttggaactgcggcggcccatggggccccgggcgggaggacaggttcttctgcccacagtgccgagcgctgcaggcacctgaccccactcgagactacttcagccttatggactggtacgagcgacggtttcgggaaacgggcccgggcgagagacacgtcgagcaaccgttccttcagagttgatacagcgaagctccagcacaggtaccagcaactgcagcgtcttgtccacccagatttcttcagccagaggtctcagactgaaaaggacttctcagagaagcattcgaccctggtgaatgatgcctataagaccctcctggcccccctgagcagaggactgtaccttctaaagctccatggaatagagattcctgaaaggacagattatgaaatggacaggcaattcctcatagaaataatggaaatcaatgaaaaactcgcagaagctgaaagtgaagctgccatgaaagagattgaatccattgtcaaagatgactttgaagaagccaaggaaattttgacaaagatgagatacttttcaaatatagaagaaaagatcaagttaaagaagattcccctttaattgtggatagtttaaag

SEQ ID NO: 175 - DNA, 2730 bp, Homo sapiens
  CDS (162)..(1886)
tttcgtctggccgggaacgcacacaacgtcaaagcagtgaataagcgatttctgcagttcccgtagctgccagcctgtgcagtcctctgtgatgcttggggaccggctcctcggtcacaccccagtcctgctctgaaggttgccgttttccaaacagaaggatggtagctagaggggagatagcaagattctggagtctggaaagccttcacttggtttcttcagatggaggtactgagccctctgccttagtggatgacaacggtagtgaggaggacttcagctatgaagacctctgccaggccagccctcggtacctgcagcccggcggggagcagctggccatcaatgagctgatcagtgatggcaacgtggtctgcgcagaagccctgtgggaccatgtgaccatggatgaccaggaactgggcttcaaagccggggatgtcatccaggttctggaagcctccaacaaggactggtggtggggccgcagtgaagataaggaagcctggttccccgcgagcttcgtcagattgcgagtgaatcaggaagagctgtcggaaaactccagcagcacccccagtgaggagcaggacgaggaggccagccagagccgccacagacactgtgagaacaagcagcagatgcggaccaacgtcatccgggagatcatggacaccgagcgggtgtacatcaaacacctcagggacatctgtgagggctatatccgacagtgccgcaagcacacaggaatgttcaccgttgcgcagctagccactatttttggaaacattgaagatatttacaaattccaaagaaagtttctgaaagaccttgagaaacagtacaacaaagaggaacctcacttaagtgaaataggatcttgctttcttcaaaatcaagagggctttgccatctattccgagtactgcaacaaccacccgggcgcctgcctggagctcgccaacctcatgaagcagggcaagtacagacatttctttgaagcctgccgcctgctgcagcagatgattgacatcgccatcgacgggttcctgctcacaccagtgcagaagatctgcaaatacccgctgcagctggccgagctgctcaagtataccacacaggaacacggtgattacagcaacataaaggcagcatatgaggccatgaagaatgtggcctgtctgatcaacgagcgcaagcgcaagctggagagcatcgacaagatagctcgctggcaggtgtctatcgtgggctgggagggactggatatcttagaccgaagctcagaattgattcattctggggagctgaccaaaatcactaagcaaggcaaaagccagcagcggacgttcttcctgtttgaccaccagctggtgtcctgcaagaaggacctgctgcgcagggacatgctgtactacaagggccggctggacatggatgagatggagcttgtggacctgggggatgggcgcgacaaggactgcaacctcagcgtgaaaaatgccttcaagctcgtcagtaggaccacagacgaggtttatttgttttgtgccaaaaaacaagaagacaaggcgaggtggctgcaggcctgtgcagatgaaaggaggcgggtgcaagaggacaaggagatgggaatggaaatttcagaaaaccagaagaaacttgccatgttaaatgctcaaaaggcaggacatggaaagtcaaaaggctacaacaggtgccctgtggccccaccgcaccagggcctgcaccccatccaccagcgccacatcactatgcccacaagcgtcccccagcagcaggtctttggcctggcggaacccaagaggaagtcctcgctcttctggcacaccttcaacaggctcacccccttccggaaatgaaaacaggaggctgtgcttccatggagctgggtgtcaagagaagaactgtctttgtttcttgtgtgcttcaatccagggaaagtttcttggacccagtgataaaaacttccttttagggatcaatgaaggagagaaggtcttggaatcaccttcagtctttggagacccagctgcctttgtggaagggaggagacggtcatgacacaaagctttatcctacacagaaacacccgtgacccactatgagatggcccagatgtgggacccggtaccatgctctaaagcgagtgattaggcagcagctgaagccacccctgctgatgatgagcaagtgcctgctgcaggtccaaacacagcatccagggctttgcagttcctaaggagtgatgaggttagaggatcacttctgcatttgattttcaaggatgccgtcaagacggggttgacacaatgctgcacgtgtctggtcacacttagaaattgagctcttactctcttctgtaatactgggggacctacagctgccgtggggctgaccacggtgttccctggcatcgtctgtgtccacacagatgctaactggtagtgcaaatgtcatcctgcaaggttcctcttcctgcaagcaaagtggagagaaagaagatgcatctgtcaccttcatcagggtcctcagtgcagagcaacttacgcatcctcaagaatccactgcttttcaggcaaggagggagaaatcctgctgcacactggctttgtcccggagtcggattccctcctgcctgcacgccttcagtaactccgagcagaaatcacatcttgcccacatgctgtaacctaagaaactgct

SEQ ID NO: 176 - DNA, 1541 bp, Homo sapiens
  CDS (44)..(1231)
tttcgtgcgggacttccgtgttggcgggattctgaacgctgccatggctcagaccgtgcagaatgttacattgtcgctcactctgcccatcacgtgccacatttgcttggggaaggtacgtcagcctgtcatatgcatcaacaaccatgtattttgttcgatttgtattgatttgtggttgaagaataatagccagtgtccagcttgcagagtccccatcactcctgaaaatccttgcaaagaaattataggaggaacaagtgaaagtgaacctatgctaagccatacggtcaggaagcatcttcggaaaactagacttgaattactacacaaagaatatgaggacgaaatagattgtttacagaaagaagtagaagagcttaagagtaaaaatctcagcttggagtcacagatcaaaactattctggatcctttaaccttggtgcagggcaaccaaaatgaagacaaacatctagtcacagataatccaagtaaaattaacccagaaactgtagcagagtggaagaaaaaactcagaacagctaatgaaatctatgaaaaagtgaaagatgatgtggataagctaaaggaggcaaataaaaaattgaaattggaaaatggtggtctggtgagggagaatttacgactgaaggctgaagttgataacagatcacctcaaaagtttggaaggtttgcagttgctgctcttcagtccaaagtagaacagtatgagcgtgaaaccaatcgcctcaagaaagccctggaacgaagtgataagtatatagaggaactagaatctcaagttgcacagctaaaaaattcaagtgaagagaaagaagctatgaattccatttgccagacagcactttctgcagatggcaaagggagcaaaggcagtgaggaggatgtggtgtcaaagaatcaaggcgatagtgccagaaagcagcctggctcatccacctccagttcttctcacctagcgaagccttccagcagcagactgtgtgacaccagttctgcaaggcaggaaagtaccagcaaagcagaccttaactgttctaagaacaaagacctatatcaagaacaggtagaagtaatgttagatgtgacagatacaagtatggatacttatttggaaagagaatgggggaataaaccaagtgactgtgtaccctacaaagatgaagaactttatgatcttccagctccttgtactcctttgtccctttagttggccttcagctcaagtactccaaaaaaaatagaagagagctttttgtggtccaaaggcaagggaagggttcccaaaaaaaagagcaactttcaaaaccccatttttcaaaaaaaaaaaattggggggggtttttggaaatggaattttggggatttcttcaaaatggtttctaataaaaagattctttcagaaagatgaatattaagttggaaggtgaaaaatgaaaaagaaaatcagaattgtttttttttcccccaaagaacagggaattttggggaattgtttggttccacaaagctaatgccca

SEQ ID NO: 177 - DNA, 1416 bp, Homo sapiens
  CDS (205)..(1305)
tggaatgctttacaagattattttggtgatttcatttgtcaacaaacaaatccatgggagtctgttgtgcataaattgaaaaagtcagaaacattatccccttaattactgcttactgagttttaaccatagtgtgctatgttagaaggcacacaattagaaaatacttgacttactcagctatataatgattaacttgaagacatgcttttagctgtaatatcatttttcttcatttttacaatcttaaaactacaaaatgctgtctttctttctttcagaacaggtgggattgttcctccagcagctcaacagcttcacagagaaaatattcaacgaatagtacaagaagctctttctgccagtggagtctctccaagtgacctctcagcaattgcaactaccataaaaccaggacttgctttaagcctgggagtgggcttatcatttagcttacagctggtaggacagttaaaaaagccattcattcccattcatcatatggaggctcatgcacttactattaggttgaccaataaagtagaatttccttttttagttcttttgatttctggaggtcactgtctgttggcattagttcaaggagtttcagattttctgcttcttggaaagtctttggacatagcaccaggtgacatgcttgacaaggtggcaagaagactttctttaataaaacatccagagtgctccaccatgagtggtgggaaagccatagaacatttggccaaacaaggaaatagatttcattttgacatcaaacctcccttgcatcatgctaaaaattgtgatttttcttttactggacttcaacacgttactgataaaataataatgaaaaaggaaaaagaggaaggtattgagaaggggcaaatcctgtcttcagcagcagacattgctgccacagtacagcacacaatggcatgtcatcttgtgaaaagaacacatcgggctattctgttttgtaagcagagagacttgttacctcaaaataatgcagtactggttgcatctggtggtgtcgcaagtaacttctatatccgcagagctctggaaattttaacaaacgcaacacagtgcactttgttgtgtcctcctcccagactatgcactgataatggcattatgattgcatggaatggtattgaaagactacgtgctggcttgggcattttacatgacatagaaggcatccgctatgaaccaaaatgtcctcttggagtagacatatcaaaagaagttggagaagcttccataaaagtaccacaattaaaaatggagatatgatttctgctgttcaaaaaagtccctaaagggtctcactctctgacctcagctggagtacagtagccagatcacaactcactgcaaccctgacttcctgaactcaagaaatct

SEQ ID NO: 178 - DNA, 2258 bp, Homo sapiens
  CDS (101)..(619)
gcacgagccaaagcgggacaggtccagcggttgttctgtgtgaagtcgcgcggcttccacccacgcagtgttctaagtgaaggccagaaactcgctcgccatgtcggctgcagaggcggggggtgttttccacagagccaggggcaggaccctggccgcgtttcccgcagaaaaggaaagcgaatggaaaggcccattctacttcatcctgggcgcagacccacagtttgggctgatcaaggcctggtccactggggactgtgacaatggcggtgacgaatgggaacaggagatccgtctaactgagcaagccgtccaggccatcaacaagctgaaccccaaacccaaattcttcgttctgtgcggcgacctcatccacgccatgccaggtgtcagagtcgtgttctcaggccactaccacaggaatgccgggggtacctaccagaacctcgacatggtggtgtcatctgccattggatgccagctgggcagagacccccacgggctccgagtcgtggtggtcaccgccgagaaaattgttcaccgatactacagtctagatgagctgagtgagaaaggaatagaagacgatctcatggatttgatcaagaaaaaatgacgctccttcccgttcccgttcacttttcacttgcactatttttttattttgccagaaacagcagctgcacacaacctcttgctgaaatataaaaatagcccaggcaggtttgtgaatttatgtccttttgcataaatcagagagctggggccctgtcctgaattatattcaaaatagaactgcatttcctttaaaatggagcgaatgatcctggaaatcagtttttaaaatattagactatctctgcatggatgtttgaataaattctcctaatgctgtgtttctcaactccacttttgaattggattgtattctggttagcatatggtcaaagtctgcctatcgacctcaattccaatctgacagccaagtatgatctttgataattccttaaacaaactacacctgattgtattaaattgtggtcacgattcccaaaacgctaggcaaaacaaagttcatctcctttcctttccagcggaacgaacagctgtctgccttgttgtgagagccatgcagacttattttgacaaggagccaagtaggcaccatttactgttcaattctgagacttctgatgataggaacagaatgcagttgatacagctcggagcttaaatttgccttcctgggtgcctagaaaagtcacctttgcacataaattggccatttctgaaaatctcctccaagagactgaaaccaaagctctaaaacgccgcttcttcagtctctggggagcacgttgagttggttcacatccacattctggctgtgtagccactccacagatgggtggtctcttgggatcagaatgcccctccactcatgagactcttcattttgtccactttgacaggaaaagtgggaatgtatgcagagctctcaaaagaaacaaaaaaggccaaaacggtgccttcagccacatcctctgaattggccctgacttggactaaatgcactaatgcaaaatcccttgacaaaagcgcataggttatttcaaaccagcattgttttttatgtaacctgttttaccgcatcttctcagcagcttctgaccactgctcaattttctcctttacagccattgttctggtggacaaataacctaggtactccaaatcctggcaggaaaaatatacagcattatgaaacagcactcagtaatcctaaaatgatttccaaagctggttacacatgacctgcaaagtctattaaattaaaagactttctcattacagagtttagtcaacgtagcaaaaccatgggaaattaaatggaaagataattaaatatgtaaattcataaggaacaaaagacgagaagttaattatacaataggctggtgacaccagagttcattgttatgtgccacaagaaaattaaattttttaaaaaactagaacgctcttcttttagtgttttgctgaaatcctgttttgtatttgtttctttacaacaggtgtaggtataggaggtcaagaaaaggagttcggtaaagggcatagctaataacaaccacacattgggccaggcgcagtggcttacgcctgtaatcccagcactttgggaggctgagacgggcagatcacctgagatcaggagtttgagaacagcctggccaacatggtgaaactccatt

SEQ ID NO: 179 - DNA, 1453 bp, Homo sapiens
  CDS (127)..(1338)
gcgccgctggccgacggaggggagcctgccgatgccgagcgggtgctacgtcccgcggtcggagccgcgtcttctcccggctccgccaccagccggggctcgggtgggggcccggggccccggggcatggccctccggagtgcgcagggcgacggccccacctccggccactgggacggcggcgcggagaaggcagactttaacgccaaaaggaaaaagaaagtggcagagatacaccaggctctgaacagtgatcccactgatgtggctgcccttagacgcatggctatcagtgaaggagggctcctgactgatgagatcagacgaaaagtgtggcccaagctcctcaatgtcaatgccaatgacccacctcctatatcagggaagaacctacggcagatgagcaaggactaccaacaagtgttgctggacgtccggcggtcattgcggcggttccctcctggcatgccagaggaacagagagaagggctccaggaagaactgattgacatcatcctcctcatcttggagcgcaaccctcagctgcactactaccagggctaccatgacattgtggtcacatttctgctggtggtaggcgagaggctggcaacatccctggtagaaaaattatctacccaccacctcagggattttatggatccaacaatggacaacaccaagcatatattaaactatctgatgcccatcattgaccaggtgaatccagagctccatgacttcatgcagagtgctgaggtagggaccatctttgccctcagctggctcatcacctggtttgggcatgtcctgtctgacttcaggcacgtcgtgcggttatatgacttcttcctggcctgccacccactgatgccgatttactttgcagccgtgattgtgttgtatcgcgagcaggaagtcctggactgtgactgtgacatggcctcggtccaccacctgttgtcccagatccctcaggacttgccctatgagacactgatcagcagagcaggagacctttttgttcagtttcccccatccgaacttgctcgggaggccgctgcccaacagcaagctgagaggacggcagcctctactttcaaagactttgagctggcatcagcccagcagaggcctgatatggtgctgcggcagcggtttcggggacttctgcggcctgaagatcgaacaaaagatgtcctgaccaagccaaggaccaaccgctttgtgaaattggcagtgatggggctgacagtggcacttggagcggctgcactggctgtggtgaaaagtgccctggaatgggcccctaagtttcagctgcagctgtttccctgaaagccagagaagaccttcctcttacatcacattaaggtctcacccttccatggaaggattgggaggggtggaatttcctttattaaaagggtttctgtccaaaaaaaaaaaaaaa

SEQ ID NO: 180 - DNA, 2465 bp, Homo sapiens
  CDS (115)..(927)
aactagataagctgttacgcctgcacgtaccggtccggaattcccgggtcgacgatttcgtgccgggccgcgccgccgctgccgccgccgcgcgcggattctgcttctcagaagatgcactattatagatactctaacgccaaggtcagctgctggtacaagtacctccttttcagctacaacatcatcttctggttggctggagttgtcttccttggagtcgggctgtgggcatggagcgaaaagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagccctacgtccagagggagaggagccgacacccccagagccagtgccccatcttaagcatcagcgtgacgtgacctctctgtttctgcttgctggtgctgaagaccaagggtcccccttgttacctgcccaaacttgtgactgcatccctctggagtctacccagagacagagaatgtgtctttatgtgggagtggtgactctgaaagacagagagggctcctgtggctgccaggagggcttgactcagaccccctgcagctcaagcatgtctgcaggacaccctggtcccctctccactggcatccagacatctgctttgggtcatccacatctgtgggtgggccgtgggtagagggacccacaggcgtggacagggcatctctctccatcaagcaaagcagcatgggggcctgcccctaatgggaggcggacgtggccccgctgggcctctgagtgccagcgcagtctgctgggacatgcacatatcaggggttgtttgcaggatcctcagccatgttcaagtgaagtaagcctgagccagtgcgtggactggtgccacgggagtgccttgtccactgtccccctgtgtccaccagctattctcctggcgccggaactgcctctggtcttgatagcattaagccctgatggcgccggtggcgcggtgggcatggttcttcactgagagccggctctccttttcttaaagtgtgtaaatagtttatttataggggtaagaatgttctcacaccatttcacttcctcttcctctcctccagcattctcctctgagcagccttagatagtgtccatggctggagccgaccctttgagtccccttgagtgtcttaagaaccagcccacaacagcctctctttctcctccacatactgcagcctccctccatgcatcccacatacaagcactcccccactccccagcgtggcctcactgtcttctggtcttggtgctactgaaattgtcacccagaatttgaatcctgaccctccccactgcaagcccagggagccccagcccaagatggccagcctgaaactgttggccagggctcctcttgtggccatgtacccagggctggctggcctgccatttgcctctccccggagacagccgttcttctgcaaccacaccccgtgcctagccacaaccccaggctgcagctgctcagaagctccaggcattttgtttctggtgaccgcccctaatgggatatcggtgatcactggtccacccttcctgtcagggcttttctggggctgctcttggaaatgaagtcttaagtactgaataactcccctggggatagctggggcatttgtctagctgggctactttctaacactttgccatagctcagaccacttctcatcgttcagggatggactgcaaccttaatttacttgccggagtgtacattctagtgtggtgtatactggtggctgttgatgatga

SEQ ID NO: 181 - DNA, 1145 bp, Homo sapiens
  CDS (78)..(722)
tgcagcccttgccttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcttcctgattcccaccccaggccttgcccctgggcctcccacgaatggttaatatatatgtagatatatattttaagcagtgacctttcccagtagagccccagaggctctcaggctccttacggtccagggtgggggggtcacgccctgggctgttcgacctctggaggtgcctgctggggattcgactacccgcgatggttacctaataacatgcccattccccagtaggcctgcaaagcatgagaccaacttgggcacttattcactttatcccaggggacccagtaatttatggggggcgcaaagagcccatcacccgagaatagcaggagcgaataagtagcatcatataaccccagagacggtgataggtcaaaagacataggtagccacagaacaacacacgggagggagacaacacaaacagacgaacagcacacaaagaaagaaagacaagcaaaaaaagagtaca

SEQ ID NO: 182 - DNA, 1934 bp, Homo sapiens
  CDS (35)..(1666)
cggacgcgtgggcggagaggaggtggctccagagatggcagtgagcgagaggagggggctcggccgcgggagccccgcggagtgggggcagcggctacttctggtgctgctgttgggtggctgctccgggcgcatccaccggctggcgctgacgggggagaagcgagcggacatccagctgaacagcttcggtttctacaccaatggctctctggaggtggagttgagcgtcctgcggctgggcctccgggaggcagaagagaagtccctgctggtggggttcagtctcagccgggttcggtctggcagagttcgctcctattcaacccgggatttccaggactgccctctccagaaaaacagtagcagtttcctggtcctgttcctcatcaacaccaaggatctgcaggtccaggtgcggaagtatggagagcagaagacgttgtttatctttcccgggctcctcccggaagcaccctccaaaccagggctcccgaagccacaggccacagtcccccgcaaggtggatggcggagggacctctgcagccagcaagcccaagtcaacacccgcagtgattcagggtcctagtgggaaggacaaggacctggtgttgggcctgagccacctcaacaactcctacaacttcagtttccacgtggtgatcggctctcaggcggaagaaggccagtacagcctgaacttccacaactgcaacaattcagtgccaggaaaggagcatccattcgacatcacggtgatgatccgggagaagaaccccgatggcttcctgtcggcagcggagatgccccttttcaagctctacatggtcatgtccgcctgcttcctggccgctggcatcttctgggtgtccatcctctgcaggaacacgtacagcgtcttcaagatccactggctcatggcggccttggccttcaccaagagcatctctctcctcttccacagcatcaactactacttcatcaacagccagggccaccccatcgaaggccttgccgtcatgtactacatcgcacacctgctgaagggcgccctcctcttcatcaccatcgccctgattggctcaggctgggccttcatcaagtacgtcctgtcggataaggagaagaaggtctttgggatcgtgatccccatgcaggtcctggccaacgtggcctacatcatcatcgagtcccgcgaggaaggcgccagcgactacgtgctgtggaaggagattttgttcctggtggacctcatctgctgtggtgccatcctgttccccgtagtctggtccatccggcatctccaggatgcgtctggcacagacgggaaggtggcagtgaacctggccaagctgaagctgttccggcattactatgtcatggtcatctgctacgtctacttcacccgcatcatcgccatcctgctgcaggtggctgtgccctttcagtggcagtggctgtaccagctcttggtggagggctccaccctggccttcttcgtgctcacgggctacaagttccagcccacaggaaacaacccgtacctgcagctgccccaggaggacgaggaggatgttcagatggagcaagtaatgacggactctgggttccgggaaggcctctccaaagtcaacaaaacagccagcgggcgggaactgttatgatcacctccacatctcagaccaaagggtcgtcctcccccagcatttctcactcctgcccttcttccacagcgtatgtggggaggtggagggggtccatgtggaccaggcgcccagctccccgggaccccggttcccggacaagcccatttggaagaagagtcccttcctccccccaaatattgggcagccctgtccttaccccgggaccacccctcccttccagctatgtgtacaataatgaccaatctgtttggctaaaaaaaaaaaa

SEQ ID NO: 183 - DNA, 1098 bp, Homo sapiens
  CDS (122)..(970)
atggtcccgctactggacccatttcctacctgggaaatggagtcgaagctgactcaaaacgtaacggcccaattgtccttgagacttcattccccagcaagctcagcgtgtaacgtgcgctatggagccgaaagtcgcagagctgaagcagaagatcgaggacacgctatgtccttttggcttcgaggtttaccccttccaggtggcatggtacaatgaactcttgcctccagccttccacctaccgctgccaggacctaccctggccttcctggtactcagcacgcctgccatgtttgaccgggccctcaagcccttcttgcagagctgccacctccgaatgctgactgacccagtggaccagtgtgtggcctaccatctgggccgtgttagagagagcctcccagagctgcagatagaaatcattgctgactacgaggtacaccccaaccgacgccccaagatcctggcccagacagcagcccatgtagctggggctgcttactactaccaacgacaagatgtggaggctgacccatgggggaaccagcgcatatcaggtgtgtgcatacacccccgatttgggggctggtttgccatccgaggggtagtgctgctgccagggatagaggtgccagatctgccacccagaaaacctcatgactgtgtacctacaagagctgaccgtatcgccctactcgaaggcttcaatttccactggcgtgattggacttaccgggatgctgtgacaccccaggagcgctactcagaagagcagaaggcctacttctccactccacctgcccaacgattggccctattgggcttggctcagccctcagagaagcctagttctccctccccggaccttccctttaccacacccgcccccaagaagcctgggaatcccagcagagcccggagctggctcagccccagggtctcaccacctgcatcccctggcccttgattttctcccatgtggaccctgatttatggtggtacttgctaggacttaattgttcattcaaaaaaaggccaatctagagacctttaattatgtggtcccagcttatctgccgctagtgctggccaatg

SEQ ID NO: 184 - DNA, 973 bp, Homo sapiens
  CDS (231)..(749)
tgtaatagtctaatgctccacttaaagatacagaatgcagaatggatacgaatccaccaacctaatatctgctaacacatatggactcacataagttgagggtaaaggggtgaaaaaagatattccatgcaaatactaaccctaagcgagcagaaatagctattcttatatcagacaaaacagactttaaagcaacaatagtcgaaaaagacaaaaagggacattacataatgataaaaggatcagtccaacaggaaaatatcacaatcctaaatatatatgcacctagcacgggagctcccaaatttataaaacaattagtactcaacgtaagaaatgagatacacagctacacagtaacagcggggacttcaacactagacaggtcatcaagacagaaaggcaacaaagaaacaatggacttacactataccctagaacaaatggacttaacacatatttacagaacattctacccaacaactgcagaatatatattctattcatcagcacatggaacattctccaagatagaccagatgataggccacaaaacaagtctcagtaaacttaagaaaatcgaaattatatcaagcactctctcagatcacagtggaataaaattggaaatcaactccaaaagaaaccctcgaaaccatgcaaatacatggaaattaaataacctgttcctgaataatcgttgggtcaacaacgaaatcaagatggaaattttaaaattctttgactgaacgataatagtgacacaacctatcaaaacctctgggatacagcaaaggcagtgctaagaggaaagttcatagcctacatcaaaaagactgaaagagcacaaactgacactctaaggtcacacctcaaggaactagagaagcaagaacaaaccaaacccaaacccagcagaagaaaggaaataacaaagatcagaccagaactaaatgaaattgaaaaaaaaaaa

SEQ ID NO: 185 - DNA, 765 bp, Homo sapiens
  CDS (175)..(510)
gggctcgctgttgccctgaaggcaggcgagccagctgcccaggaaaggtggaaagtggtagaagctgacccctgagccctggcaggtctttaagtgcgtttgtgcagccgatttcaaggctaagagagaaagactgcctctgatccctgaaggaaaccgggaaaaaacctcaccatggaaaatgcccccagggaaaacaaagttggggaaaaggccccagggcaaaatgaaccccccgttttaggaggggggaaataccaggaccctggaggaaatgttaaaggggttgggcctccccctgccccggtttttgaaaaggatggccccaataggcttgtcaataactttgatatgataaagggaaatggaaatgatttggaccggttcttgggggaaatgaaaaacctaagggggaaatttagggaacttcacctgaggatcagtctgcccattcttataggcgaccctcctcaccatgatcatcatgatgagttttgccttatgccttgaatcttgaggttaataatcataaaatccctgctttctagattcgcatttttcctggtgtacctttaatgagaaccttttggcattcttctgcaattttctgattggagattgcattgtgacctagcctgtaagtttttctgtcacaagaggactttcatcatctttcatggaaagacgttcattgcatactgtacagctagtaaagcagtttaagagggggctacggtcggctacgctggggcacatctggctccc

SEQ ID NO: 186 - DNA, 3049 bp, Homo sapiens
  CDS (21)..(3002)
tgggtgcatgcgctcgcatcatggcggctgagtgggcttctcgtttctggctttgggctacgctgctgattcctgcggccgcggtctacgaagaccaagtgggcaagtttgattggagacagcaatatgttgggaaggtcaagtttgcctccttggaattttcccctggatccaagaagttggttgtagccacagagaagaatgtgattgcagcattaaattcccgaactggggagatcttgtggcgccatgttgacaagggcacggcagaaggggctgtggatgccatgctgctgcacggacaggatgtgatcactgtgtccaatggaggccgaatcatgcgttcctgggagactaacatcgggggcctgaactgggagataaccctggacagtggcagtttccaggcacttgggctggttggcctgcaggagtctgtaaggtacatcgcagtcctgaagaagactacacttgccctccatcacctctccagtgggcacctcaagtgggtggaacatctcccagaaagtgacagcatccactaccagatggtgtattcttacggctctggggtggtgtgggccctcggagttgttcccttcagccatgtgaacattgtcaagtttaatgtggaagatggagagattgttcagcaggttagggtttcaactccgtggctgcagcacctgtctggagcctgtggtgtggtggatgaggctgtcctggtgtgtcctgacccgagctcacgttccctccaaactttggctctggagacggaatgggagttgagacagatcccactgcagtctctcgacttagaatttggaagtggattccaaccccgggtcctgcctacccagcccaacccagtggacgcttcccgggcccagttcttcctgcacttgtccccaagccactatgctctgctgcagtaccattatggaacgctgagtttgcttaaaaacttcccacagactgccctagtgagctttgccaccactggggagaagacggtggctgcagtcatggcctgtcggaatgaagtgcagaaaagtagcagttctgaagatgggtcaatggggagcttttcggagaagtctagttcaaaggactctctggcttgcttcaatcagacctacaccattaacctatacctcgtggagacaggtcggcggctgctggacaccacgataacatttagcctggaacagagcggcactcggcctgagcggctgtatatccaggtgttcttgaagaaggatgactcagtgggctaccgggctttggtgcagacagaggatcatctgctacttttcctgcagcagttggcagggaaggtggtgctgtggagccgtgaggagtccctggcagaagtggtgtgcctagagatggtggacctccccctgactggggcacaggccgagctggaaggagaatttggcaaaaaggcagatggcttgctggggatgttcctgaaacgcctctcgtctcagcttatcctgctgcaagcatggacttcccacctctggaaaatgttttatgatgctcggaagccccggagtcagattaagaatgagatcaacattgacaccctggccagagatgaattcaacctccagaagatgatggtgatggtaacagcctcaggcaagctttttggcattgagagcagctctggcaccatcctgtggaaacagtatctacccaatgtcaagccagactcctcctttaaactgatggtccagagaactactgctcatttcccccatcccccacagtgcaccctgctggtgaaggacaaggagtcgggaatgagttctctgtatgtcttcaatcccatttttgggaagtggagtcaggtagctcccccagtgctgaagcgccccatcttgcagtccttgcttctcccagtcatggatcaagactacgccaaggtgttgctgttgatagatgatgaatacaaggtcacagcttttccagccactcggaatgtcttgcgacagctacatgagcttgccccttccatcttcttctatttggtggatgcagagcagggacggctgtgtggatatcggcttcgaaaggatctcaccactgagctgagttgggagctgaccattcccccagaagtacagcggatcgtcaaggtgaaggggaaacgcagcagtgagcacgttcattcccagggccgtgtgatgggggaccgcagtgtgctctacaagagcctgaaccccaacctgctggccgtggtgacagagagcacagacgcgcaccatgagcgcacctttattggcatcttcctcattgatggcgtcactgggcgtatcattcactcctctgtgcagaagaaagccaaaggccctgtccatatcgtgcattcagagaactgggtggtgtaccagtactggaacaccaaggctcggcgcaacgagtttaccgtactggagctctatgagggcactgagcaatacaacgccaccgccttcagctccctggaccgcccccagctgccccaggtcctccagcagtcctatatcttcccgtcctccatcagtgccatggaggccaccatcaccgaacggggcatcaccagccgacacctgctgattggactaccttctggagcaattctttcccttcctaaggctttgctggatccccgccgccccgagatcccaacagaacaaagcagagaggagaacttaatcccgtattctccagatgtacagatacacgcagagcgattcatcaactataaccagacagtttctcgaatgcgaggtatctacacagctccctcgggtctggagtccacttgtttggttgtggcctatggtttggacatttaccaaactcgagtctacccatccaagcagtttgacgttctgaaggatgactatgactacgtgttaatcagcagcgtcctctttggcctggttttagccaccatgatcactaagagactggcacaggtgaagctcctgaatcgggcctggcgataaagaacaaagactgtgcctaaaagtggagagccaggggagtgtggggc

SEQ ID NO: 187 - DNA, 2607 bp, Homo sapiens
  CDS (606)..(2465)
gctccgggccaccggcagaaggcccgcctgtacacgacacggccactgtctaaggtgccaggcccccgcgccgccctccggcgtcctgtccgggacggcgcaacgtcgtgtgccagccagtcccagcccacgcgaattacgtaaagtacgtccaagaggagtcccatacagggccccttccgtccagaactctgcccagcccaggaccaggttccgagatgttaccaccaggcccagagctgggcgggggcgtggaaaacgcgagggagccttcccgcccccatctccggtctccctccctccccttcccaagccacctgcacggcatcccagccgagcttccgccccccgcggtggccccgcctccccgccgcccggaaagacgggctgacggccccctcccgaaacccggggaagtggattctacgctccagctccgctccgctccgctccgctccgccccgcaccaccaaccccgggccgcagtcctgacgagcgggtcagggcttgtcgggcggaagcctggcctggagcctggaagggggagacggcccgagcgggagcgggagcggacgcggcctcagtcctgcgcggaatattgaaggatgtttgttccaagatctctaaaaatcaagaggaatgctaatgatgatggcaaaagttgtgtggctaagataattaaaccagacccagaagaccttcagttggacaaaagcagagatgttcccgttgatgctgtagctacagaagcagccacaatagacaggcacatcagcgaatcatgccctttccccagcccaggtggccagttggcagaggttcattcagtaagtcccgagcagggtgcgaaggacagccatccttctgaagagcccgttaagtcattttccaaaacacagcgctgggcagaaccaggggaacccatctgtgttgtctgtggtcgttatggagagtatatctgtgataagacagatgaagatgtgtgtagtttggagtgtaaagcgaaacatcttctacaagttaaggaaaaggaagagaaatcaaaactcagcaatccacagaaggctgattctgagccagagtctccactgaatgcttcctatgtctacaaagagcacccctttattttgaaccttcaggaagaccagattgaaaatcttaaacagcagctgggaattttagttcaagggcaagaagtcaccaggcccattattgactttgaacattgtagtctccctgaggtcttaaatcacaacttgaagaaatcaggctatgaggtgccaactcccattcaaatgcagatgattcctgtgggacttctgggaagagacattctggccagtgcagatactggctcaggaaaaacagctgcttttcttcttcctgttatcatgcgagctttattcgagagcaaaactccatctgcgctcattcttacaccaaccagagagttagccattcagatagagagacaagctaaagaattgatgagtggcctgccacgcatgaaaactgtgcttcttgtagggggcttacccttacccccacagctttatcgtctgcaacaacatgttaaggttatcatagcaacccctgggcgacttctggatataataaagcagagctctgtagaactctgtggtgtaaagattgtggtagtagatgaagctgataccatgttaaagatgggttttcaacaacaagtgcttgacattttggaaaacattcctaatgattgtcagaccattttggtttcagccacaattccaactagcatagaacagctagcaagccagcttctgcataatcctgtgagaattatcactggagaaaagaacctaccttgtgccaatgtacgtcagattattttgtgggtagaagacccagccaaaaagaaaaaattatttgaaattttaaatgataagaaactctttaagcctccagtgttagtatttgtggactgcaaactaggagcagatcttttgagtgaagccgttcagaaaatcacagggctgaaaagcatatctatacattcggagaagtcgcaaatagaaaggaaaaacatattgaagggattacttgaaggagactatgaagttgtagtgagcacaggagtcttgggacgaggcctagacttgatcagtgtcaggctggttgtcaattttgatatgccttcaagtatggatgagtatgtccatcagattggaagagtaggaagattaggtcaaaatggaacagcgattactttcatcaataataattcaaaaagactcttctgggatattgcaaaacgagtaaagcccacaggatccattcttccccctcagttattaaattccccataccttcatgaccagaagagaaaggaacaacagaaagataaacagacacagaatgatctggttacaggagctaatcttatggatattatcagaaaacatgataaaagtaattctcagaaatgattttctctgccacttgaatatttttttttattgtatatagtcagcaaaaaattatggtttgcataaatggaaatgtacatgaattttaaaaattttaagatatttttaatttaataaaatttatataactaaaaaaaaaaaa

SEQ ID NO: 188 - DNA, 2252 bp, Homo sapiens
  CDS (112)..(1710)
gttcgcaccccagggtctcaccggcaagggaaggattttctggagagggatccctcaggagggtgtgttccggatttcttgcctcaggcccaagactccaaccattttataatggaatctttattttgtgaaagtagcggggactcatctctggagaaggagttcctcggggccccagtggggccctcggtgagcacccccaacagccagcactcttctcctagccgctcactcagtgccaactccatcaaggtggagatgtacagcgatgaggagtcaagcagactgctggggccagatgagcggctcctggaaaaggacgacagcgtgattgtggaagattcattgtctgagcccctgggctactgtgatgggagtgggccagagcctcactcccctgggggcatccggctgcccaatggcaagctcaagtgtgacgtctgcggcatggtctgtattggacccaacgtgctcatggtgcacaagcgcagtcacactggtgaaaggcccttccattgcaaccagtgtggtgcctccttcacccagaaggggaacctgctgcgccacatcaagctgcactctggggagaagccctttaaatgtcccttctgcaactatgcctgccgccggcgtgatgcactcactggtcacctccgcacacactcagtctcctctcccacagtgggcaagccctacaagtgtaactactgtggccggagctacaaacagcagagtaccctggaggagcacaaggagcggtgccataactacctacagagtctcagcactgaagcccaagctttggctggccaaccaggtgacgaaatacgtgacctggagatggtgccagactccatgctgcactcatcctctgagcggccaactttcatcgatcgtctggccaatagcctcaccaaacgcaagcgttccacaccccagaagtttgtaggcgaaaagcagatgcgcttcagcctctcagacctcccctatgatgtgaactcgggtggctatgaaaaggatgtggagttggtggcacaccacagcctagagcctggctttggaagttccctggcctttgtgggtgcagagcatctgcgtcccctccgccttccacccaccaattgcatctcagaactcacgcctgtcatcagctctgtctacacccagatgcagcccctccctggtcgactggagcttccaggatcccgagaagcaggtgagggacctgaggacctggctgatggaggtcccctcctctaccggccccgaggccccctgactgaccctggggcatcccccagcaatggctgccaggactccacagacacagaaagcaaccacgaagatcgggttgcgggggtggtatccctccctcagggtcccccaccccagccacctcccaccattgtggtgggccggcacagtcctgcctacgccaaagaggaccccaagccacaggaggggttattgcggggcaccccaggcccctccaaggaagtgcttcgggtggtgggcgagagtggtgagcctgtgaaggccttcaagtgtgagcactgccgtatcctcttcctggaccacgtcatgttcactatccacatgggctgccatggcttcagagacccttttgagtgcaacatctgtggttatcacagccaggaccggtacgaattctcttcccacattgtccggggggagcataaggtgggctagcaacctctccctctctcctcagtccaccactccactgccctgactacaggcattgatccctgtccccaccatttcgcaaggagttttgctttgtagccctcactactggccacctgacctcacacctgaccctgacccctcctcacctattctcttcctctatcctgaccgatgtaagcattgtgatgaaacagatcttttgcttatgtttttcctttttatcttctctcatcccagcatactgagttatttattaattagttgatttatttttgcctttttaaattttaacttatatcagtcacttgccactcccccaccctcctgtccacaactcctttccactttaggccaatttttctctcttagatcttccagcagccccaggggtaggaagctcctcttagtactaagagacttcaagcttcttgctttaagtcctcaccctttacattatctaattcttcagttttgatgctgatacctgcccccggccctaccttagctctgtggcattatatctcctctctgggactcttcag

SEQ ID NO: 189 - DNA, 2824 bp, Homo sapiens
  CDS (1)..(2079)
atgaagagaaaatgtgttctgattgatggcaatgttaggccaaaaagcattcagctacatgaagacttcagcaagggatcccctaaaactagtgacatcaagccatttactgcaagtggaaaaatatggaagaatatccaggaaaacaaaaataaaagctatgaaaggggactacatctaccagtcactaaaacatattctaaggcctctaaaataaaaacagtggtcctggtgcatgacaagaaagagcagtacaaccgaaaagaaagtccagaagtaaacccaaatacatatgggaatttagtatgcaataaaggtggcatctcaaatcacttggacaaagatggacttaacaattggtgtacgcgtcagcggggcaggaaacggaaagacagtgcagtaattggtggaaagctggaagtgggcacctcgagggcctcagccccacgaacacagtcacccaggaaaagcgaaccgcgccaggccctgtcatcgaccgctgggtccgtcctcccagcgctcgcggccgctcacatgggcgtggccctgcgtgacctgccggggcgtcacgtgagctcccggagtcatgtgaccgccgtcttgacagtgttccacgggcgctgcttcctgcctgggtttggagttgtcaccactttcccctctccgtctcctgcgggcgcaatggaggaggaggatgaggaagcgcgggcgctcctggcaggcggccctgacgaggccgacagaggtgccccggccgcccctggagccctgccggccctctgcgaccccagtcgcctggcgcaccggcttttggtgctgttactgatgtgcttccttggctttggcagctatttttgctatgataatcctgctgcccttcagactcaagttaaacgagatatgcaagtgaataccacgaaattcatgctgctgtatgcctggtattcttggcccaatgtagttttgtgtttctttggtggctttttgatagaccgagtatttggaatacgatggggcacaatcatttttagctgctttgtttgcattggacaggttgtttttgccctgggtggaatatttaatgctttttggctgatggaatttggaagatttgtatttgggattggtggcgagtccttagcagttgcccagaatacatatgctgtgagctggtttaaaggcaaagaattaaacctggtgtttggacttcaacttagcatggctagaattggaagtacagtaaacatgaacctcatgggatggctgtattctaagattgaagctttgttaggttctgctggtcacacaaccctcgggatcacacttatgattgggggtgtaacgtgtattctttcactaatctgtgccttggctcttgcctacttggatcagagagcagagagaatccttcataaagaacaaggaaaaacaggtgaagttattaaattaactgatgtaaaggacttctccttacccctgtggcttatatttatcatctgtgtctgctattatgttgctgtgttcccttttattggacttgggaaagttttctttacagagaaatttggattttcttcccaggcagcaagtgcaattaacagtgttgtatatgtcatatcagctcccatgtccccggtgtttgggctcctggtggataaaacagggaagaacatcatctgggttctttgcgcagtagcagccactcttgtgtcccacatgatgctggcctttacgatgtggaacccttggattgctatgtgtcttctgggactctcctactcattgcttgcctgtgcattgtggccaatggtggcatttgtagttcctgaacatcagctgggaactgcatatggcttcatgcagtccattcagaatcttgggttggccatcatttccatcattgctggtatgatactggattctcgggggtatttgtttttggaagtgttcttcattgcctgtgtttctttgtcacttttatctgtggtcttactctatttggtgaatcgtgcccagggtgggaacctaaattattctgcaagacaaagggaagaaataaaattttcccatactgaatgagaagttaaaatgaatgtgtcatgagaatgggcttaacacatcgttggtttgaaaacttccatttttaaaaatttagagttttagtcattagaaaaaataatggactggaaagttatatttatatccaaatatacctatttcaaagtgtatttgtgaggcctgttttagcctgtgtcttttgtattgtgtgttgctaaagaattctacttttagtaggctaatcaacaatgaaagggttagaaaattgctgtggaacatccaggtgaacttcaggaaagacagtgaaaaatggaaaacgttggagcttctgttgagataatcttcattaggtatatatcttagggatacagccttttctttatcttatagcaggaaaaaaaaacttttgagggaaatagaagggctgcgttacacaaaataaacaatggcattgtcataggccttccttttactagtagggcataatgctagggaatatgtgaagatgtttttatgaagtctctttctgatcacgaacaatagcttgcgctctactctgtagttatgtggattgccgagcaatgacccttttcaatttcttatttctgtgttactgaggaccctaatcacttagggatgtaattttatagtataaactttctgtacagtttttcttatagtctaataagtaaaaagtgtccttcaaattatgataattgcctatgtacatggataaattaaaacactgcacacggaaaaaaaaaaa

SEQ ID NO: 190 - DNA, 1215 bp, Homo sapiens
  CDS (13)..(612)
gcggagtgtgccatgagcgagagggaggctgccccaaatgaggaattggtgcaaagaaacaggttaatatgcagaagaaatccatataggatctttgagtatttgcaactcagcctagaagaggcctttttcttggtctatgctctgggatgtttaagtatttactatgagaaggagcctttaacgatagtgaagctctggaaagctttcactgtagttcagcccacgttcagaaccacctacatggcctaccattactttcgaagcaagggctgggtgcccaaagtgggactcaagtacgggacagatttactgctatatcggaaaggccctccattttaccatgcaagttattctgtcattatcgagctagttgatgaccattttgaaggctctctccgcaggcctctcagttggaagtccctggctgccttgagcagagtttccgttaatgtctctaaggaacttatgctgtgctatttgattaaaccctctactatgactgacaaggaaatggagtcaccagaatgtatgaaaaggattaaagttcaggaggtgattctgagtcgatgggtttcttcacgagagaggagtgaccaagacgatctttaacaattcaacctcaaatttctaatttcaccaacaactatttattgagggctaggtaaaaagttctttttgttgtaatcgtccattaattcataagttttaaagggcatggtgctcccagcaccagaaaactatcagtgtttttaaagataaattacacaagggaggagaaagatccctgtgctaggactgcagattctatacttgcgttggcctctaactctccaatccagagcctcctgcctctggcgtcagtcttttccctcatccactcactggggagattggactagaggagtcctgagaggacacttccaacaagagacatttattctctgattttacctgaaaatggtagtagtttacatttatacagtacagtttatgaagcactttcatacgcaggcatctcttgttacctacatctaagctgttcccgaaagagtgttacagaacacaacagtattgtacaatattcgataagcatatcttcactgcacttgttataaaaatgagtggtgaaataatgtttggagacataatgaaagcgattaacatttggcaaaatataataaagcctttttgtaattggtgaaaaaaaaaaaa

SEQ ID NO: 191 - DNA, 5854 bp, Homo sapiens
  CDS (261)..(2078)
cgcccggggaaggcgggccatgggcgcgggtgcgggcgccccagccggccgcgatcgcgggatttctgcgccaggagatgaggggcggtagagccctggaatggagatgtccttgacgcctgggcagaggctgcagctgcaggaccctgtggccactggagataagtaatggtgccatttgaacacctactggaaacggggcaggaacagtgagtgaccccaggcgagcacaggcaggtgccaggagccaggatgcaaggatgacgcctccggaggccctggcctcacttcccacctgggcgctaggagccatcccggggctccagccaggagccctgctgcccaggggcatggccaaacctttcttccgactccagaagtttctccgccgaacacagttcctgctgttcttcctcacggctgcctacctgatgaccggcagcctgctgctgctgcagcgggtccgcgtggctctcccacagggcccccgggcacccggccccctgcagaccttgccagtggccgccgtggcgctgggcgtgggcttgctggacagcagagccctgcacgaccctcgagtcagcccagagctgctgctgggtgtggacatgctgcagagccccctgacccggccccggcccggcccccgctggctccggagccgcaactcggagctgcgtcagttgcgtcgccgctggttccaccacttcatgagtgactcccagggaccgcccgccctgggccccgaggctgccaggcccgccatccacagccgaggcacctacattggatgcttcagtgacgatggccatgagaggactctgaaaggagctgtgttttatgacttgagaaagatgactgtctcccactgccaggatgcgtgtgctgagcggtcctatgtctacgccggcttggaggccggggcggagtgttactgcgggaaccggctgccagcggtgagcgtggggctggaagagtgtaaccatgagtgcaaaggcgagaagggctctgtgtgcggggctgtggaccggctctccgtgtaccgtgtggacgagctgcagccgggctccaggaagcggcggaccgccacctaccgcggatgcttccgactgccagagaacatcacacatgccttccccagctccctgatacaggccaatgtgaccgtggggacttgctcgggcttttgttcccagaaagagttccccttggccattctcaggggctgggaatgctactgtgcttaccctaccccccggttcaacctgcgggatgccatggacagctcagtatgtggccaggaccctgaggcacagaggctggcagaatactgtgaggtctaccagacacctgtgcaagacactcgttgtacagacaggaggttcctgcctaacaaatccaaagtgtttgtggctttgtcaagcttcccaggagccgggaacacgtgggcacggcacctcattgagcatgccactggcttctatacagggagctactactttgatggaaccctctacaacaaagggttcaagggcgaaaaggaccactggcggagccgacgcaccatctgtgtcaaaacccacgagagtggcaggagggagattgagatgtttgattcagccatcctgctaatccggaacccatacaggtccctggtggcagaattcaacagaaaatgtgccgggcacctgggatatgcagctgaccgcaactggaagagcaaagagtggccggactttgtcaacagctacgcctcgtggtggtcctcgcacgtcctggactggctcaagtacgggaagcggctgctggtggtgcactacgaggagctgcggcgcagcctggtgcccacgttacgggagatggtggccttcctcaacgtgtctgtgagcgaggagcggctgctctgcgtggagaacaacaaggagggcagcttccggcggcgcggccggcgctcccacgaccctgagcccttcaccccggagatgaaagacttgatcaatggctacatccggacggtggaccaagccctgcgtgaccacaactggacggggctgcccagggagtatgtgcccagatgataggcctggcccacgccgccgcccccgctgagtgacgcaatcgcaccacggggctgcgctccccactctgatgctcaggcccgtggcctcactgggacgaacggtgggtggggggctcaccctggtgctgcctcccgcacaaggagacctggacacaacagacacacatcacaaggcgaacacaaatggacacacatacctggccacgaacccacacctcctcagacactcagacaccactccaggctcatagccccgtcttgatgcagagaagccacccacgtggggtgtgccaggcacccccagctacaaatgcagccacgcacagacgtaacacacaggtgccaggccgtgtgctcctggaggctggctggctgtctctctcacacagatacacgtgcgctccctgggatccgggaggccctgggcttcctgtgtgtagccctggcatagacttgctcgtcagggtgttcgactctgggatgctgggccgggcagacatttatgctctgagcagcaaggaccattgggatggaggtgggcacaaagactgctgcttccagggtgtgcggccctggccgtgtgtctgacatcccataaatgtgtgtgtggtgtgactacgggcaccacaaactccgcagccttgcctctcttttctctgtggctgggctggctgcaccatgggcagggttgaggactgccccccaccccgcccaagccaatgcagacactgacctcaagaccagccacaccaagtctgtgcactgcccaccacccccttcgacccctcctacaccatgctcctgggcctggggcctccttgcctggcttcttcctccagctatcctcagggaagctggagattcaagtcatgccccagaagcaaggtgtaagcatgggggcgtggggaagagggcaggagctgaagttccaggggagcccaggacccctggggacctgtacactagcaggatgggtcttgggagttggcatggggagattgtaagggctgtatctccgcgattactggtactggtgctccacccataggggccctgttctctctggggtcccacactggggtcatgagagctagttctcatgagagcaggacccctaggtctggtcctgccagcctgggatgggggtcaatgtatgctacacatcttgggctcacaagtgaggctgtggaggccaggaggttcaagtatggagggtaggagtgcaacccaggagcaacgctcaaggtggccgagatgcagggaggattgtggcgatccggttgcacactggcctctgtggaggtcagggaggtgggaaggtgggtgggcctgaactcaggcagcccttcagtggcttcttcaggcctaggataaccctggccaggccccatggtcctgctctgggtcagctgtcagggagacctcccttcagcctgagccaagctgcattgggaggagaaggcagggtgagggatctgggagagcaggatgttgagatatcctgaccctctgcttcctagcctgatgatggggaacacagagccacccgctatgagcacaggccgggggtggaaggcccagtagagctgcccttccccagatggaagcttcctccaaccttcagtttggccagtgggtgggtttgggcatctgtgcccctggtggcctccaaatccttcctgggattcccccaaacccacactgatgcgaagctgttcttgaccctcccatagcatcaactcagttcagctcaaagctagaaacaccaaggtctttgaaaatgtttattggctcaggatagcttcagcatccaatctgcgaaggcccctgatggagctatttcttcctagtatcaggagcaattgagacccctcaggagtttccacactgctgtggacgggatagccagggcagacctgcatcccagagcaagcctagatccttgaaagcaatgtcaggcgtggcagtggggaagccatggaggctgggaagggcaaagtgtggagagaggagtgaccgggactggagccagggtctggggagagcaacagcaccaggcttttcctggtagttggattggtacattcactgctgccaggtacccagagatgtcatctctctccaggtagagcatcaccagctcctgtggccttgtagatgactctgtacctcagtgaagagtgcaggcaagtagagtgatggggtcagtgtccatccagtttacgctgagtcagtccatacagcaagacacctggcacttggcaggtactcctggatgttgatgagcaaggaagagcaacggccctgtcagctggcagtggtcctcacagccttcatcccaggtctgcctacgtgggagatctcatcagaaacaggaacggggatctgtctgtgcttgcaggaaagtccatttgtttttctccaagttaggtctcatctacagctcttagcttctcagtaaagaggatactctcccaaccagccaaggaataaaagctgatctgtatgtagggcagaagtgtggcaaatgcatcaggaaccggttagaacagaacagagaaaccctgactgtctacagattccaactttaatagcaagcctgtggagttacacaaacctgtgttaaaacatgtaatttttatggatttcatctcccgttgtggatcaatttggaaaaaccaaaatatgtaattttaaaaaactaaaacacatcctggtagtcccagtgatgtgtaaatgagagagaagaatagacaggcttccaaaccctgggaagaaagctgcttaattatgtgaacatcttataatgaagtctcttgcagctaaaattagattttgagtgcatgaatctgtgataatgtttgcatatcagaatgcattctccccttaaaagtagcagtagccacttggttcttagggggccccaagaggagaggagaagtgctgaggttgatgttacgactgcaagaattcttgggacacaggtttgttttctgctgacttgctcggaaacccattggaggtatctgaaatgtgatgactccaaaggggttcatttcactatagggagaaattgattcgtctgacttcctatttatcaccactcaatattgggtgagttggtctgaacaaggtggggataaagtagagtggaaataatgtagagtcgtcagactgaaaggccaggttgtagtcccagctcttatctgccatcttggacaaagcttttcccatctccagtctcagtttcccatccataaaatgggggaagtggtaggtcttgctgattgcatccacattcattcctccatttcctttcccagcaaccccccatttctgtttgggaattcatatgatctgccagagcctctccaggggtggaatacatgtcctggactaagccaatgacaccttccatctttccagctatggtgactgggttaggtatgatcttgtgagttaagacaatgaagccagagggaatttcaagacttatgggaatgctgggtagaagctgttttaattcccctgttgaatgtgaaaaaggtagtagtattcctgggtctttatgatgaccaccttgggccttgggatcatgaccaggaatcacgtgaagctgacaccactgaagggagagttgagaggcagaaagagatcaagtccttggtgaaattgtttaagtacaggatcaagccttgcttgagattggccttacctctggactttttttgttatatgagctaataaattctgtttattgtttaaaaaaaaaaa

SEQ ID NO: 192 - DNA, 3448 bp, Homo sapiens
  CDS (77)..(3370)
gagtcagaggtaccaggtgggtgtacattacgaattgactgaggaagagaaattctatcggaatgctttaacacggatgcctgatggccctgttgccctggaagagtcgtattctgctgtcatgggcattgtatctgaagttgaacagtatgtcaaggtttggcttcagtatcagtgtttatgggatatgcaagctgaaaacatctataacagacttggagaagatctcaacaaatggcaggctctcctggtccaaataaggaaggccagaggaacctttgacaatgcagaaaccaagaaagagtttggaccagtagttatagattatggcaaggtacaatctaaggtgaacttgaaatatgactcttggcataaggaggttcttagcaaatttgggcagatgctaggatcaaacatgacggaattccattcccagatctcaaagtcccgccaagagttggagcagcactcagtagacacggccagcacctccgatgcagttaccttcatcacctatgtgcagtctttgaaacggaagatcaagcagtttgagaagcaagttgagctctaccgcaatggccagcgcttactggaaaagcaaaggttccagttcccaccttcctggctttatattgacaacatcgagggagagtggggagccttcaatgacatcatgcggcgaaaggactctgccattcagcagcaggtggcaaacctgcaaatgaagattgtccaggaggatcgggccgtggaaagccgcaccaccgacctgctgactgactgggagaagaccaagcctgtcacgggcaaccttcgcccagaagaggcacttcaggctctcaccatatatgaggggaagtttggtaggctgaaggacgacagagagaagtgtgcaaaggccaaggaggcgctggaattgacagatactgggcttctcagtggcagtgaagagcgcgtgcaggtggccttagaagaattacaggacctcaaaggcgtttggtcagaactttctaaggtttgggagcaaatcgatcagatgaaggagcaaccctgggtttcagtacagcctcgaaagcttcgacaaaatttggatgccctcctgaaccagctgaaaagcttccctgcccggttgcgacagtatgcgtcctatgagtttgttcagaggcttctgaaaggttacatgaagataaatatgctggtgattgaactgaaatccgaagcacttaaagaccgccattggaaacagctcatgaaaaggcttcacgttaattgggttgtttctgagctaacccttggccaaatctgggatgttgacttgcagaaaaatgaagcgattgtcaaggatgtactgcttgtggcacaaggggagatggctttggaagaatttttgaagcagataagagaagtgtggaatacttatgaactagacttggttaattatcagaacaagtgccgcttgatccgtggctgggatgacctcttcaacaaggtcaaagaacacatcaacagcgtctcggccatgaagctctctccgtattacaaggtttttgaagaggatgctctcagctgggaagataagctgaacaggatcatggctctctttgatgtgtggattgatgtgcagaggcggtgggtctacctggaaggtatcttcacaggcagtgcagatatcaagcacctgctgccagtggaaacccagcggtttcagagcatcagcactgagtttttggctctaatgaaaaaagtgtccaagtctccccttgttatggatgttctgaacatccagggagtacagaggtctctggaaagattggcagacctgctaggaaagatccagaaagcattgggagaatatctggaaagagagcggtcatctttccccaggttctattttgtgggtgatgaagatttgcttgaaatcattggaaacagcaagaatgtcgctaaattacagaaacacttcaagaagatgtttgctggagtttcgagcatcatcctgaacgaggataactctgttgttttgggtatttcatctcgggaaggagaggaggttatgtttaaaactcctgtgtcaattactgaacatcccaaaatcaatgagtggctcacattggtagaaaaggagatgagagtcaccctggccaaactgcttgctgagtctgttacggaagttgagatttttggtaaagcaacttcaattgacccaaatacctacatcacttggattgataaataccaggcccagcttgtggttttgtcagcccagatagcctggtctgagaacgtggagaccgcactgagcagcatgggcggaggtggagatgccgcgcccttgcactctgtgctgagcaatgtggaggtcaccctcaatgtgttagcagactctgtcctcatggagcagcccccactccgaaggcggaagctagaacacttgattacagagttggttcaccagagagatgttacaaggtccttgatcaaaagcaagattgacaacgccaaatcttttgaatggctcagccagatgcgattttactttgaccctaagcaaactgatgtgttacagcagttgtcaattcaaatggcaaatgccaaatttaactatggctttgagtacctgggtgttcaggacaaactggtccagacccccctcactgaccgctgctatttgacaatgacacaagccttggaggccaggctggggggttccccatttggacctgctggaactgggaaaacagagtctgtcaaagctcttggccatcagcttggacggtttgttttagttttcaactgtgatgaaacctttgatttccaggcaatgggccggatctttgtgggcctttgccaggtgggtgcctggggctgctttgacgagttcaaccgcctggaggagcggatgctctcggctgtgtcccagcaggtgcagtgcatacaggaagcactgcgtgaacattccaaccccaactacgacaagacctctgcccccattacttgtgagctgctgaacaaacaagtcaaggtgagcccggacatggccatcttcatcaccatgaaccctggctacgcgggccggtctaaccttcctgacaacttgaagaagctgttccggagcttggccatgaccaagcccgaccggcagttaatcgcccaggtcatgctgtactcacagggtttccgcactgctgaagtgcttgccaacaaaatcgtcctgttttttaaactatgcgatgagcagctctcttcccaaagccattatgacttcggtcttcgggctttgaagagtgtgctggtgagtgcaggcaatgtgaagagagagagaatccagaagataaagagggagaaagaggaacgaggggaagaaaattgacaaatacacagaggtcctcaagacccacggactcctggtctgagcccaataaagactgttaattcctaaaaaaaaaaa

SEQ ID NO: 193 - DNA, 4477 bp, Homo sapiens
  CDS (103)..(4407)
aatggaagagcgactagcaaagtttatttcctccaacactccgacagcgtgctgcccttggcagatggagccctgagctttattcatcatcaggtgattgagatggcccgagactgcctggataaatctcggagtggcctcattacatcacaatacttctacgaacttcaagagaatttggagaaacttttacaagatgctcatgagcgctcagagagctcagaagtggcttttgtgatgcagctggtgaaaaagctgatgattatcattgcccgcccagcacgtctcctggaatgcctggagtttgaccctgaagagttctaccaccttttagaagcagctgagggccacgccaaagagggacaagggattaaatgtgacattccccgctacatcgttagccagctgggcctcacccgggatcccctagaagaaatggcccagttgagcagctgtgacagtcctgacactccagagacagatgattctattgagggccatggggcatctctgccatctaaaaagacaccctctgaagaggacttcgagaccattaagctcatcagcaatggcgcctatggggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaagggggagactgtgccactctgctgaagaatattggggccctgcctgtggacatggtgcgtctatactttgcggaaactgtgctggccctggagtacttacacaactatggcatcgtgcaccgtgacctcaagcctgacaacctcctaattacatccatggggcacatcaagctcacggactttggactgtccaaaatgggcctcatgagtctgacaacgaacttgtatgagggtcatattgaaaaggatgcccgggaattcctggacaagcaggtatgcgggaccccagaatacattgcgcctgaggtgatcctgcgccagggctatgggaagccagtggactggtgggccatgggcattatcctgtatgagttcctggtgggctgcgtccctttttttggagatactccggaggagctctttgggcaggtgatcagtgatgagattgtgtggcctgagggtgatgaggcactgcccccagacgcccaggacctcacctccaaactgctccaccagaaccctctggagagacttggcacaggcagtgcctatgaggtgaagcagcacccattctttactggtctggactggacaggacttctccgccagaaggctgaatttattcctcagttggagtcagaggatgatactagctattttgacacccgctcagagcgataccaccacatggactcggaggatgaggaagaagtgagtgaggatggctgccttgagatccgccagttctcttcctgctctccaaggttcaacaaggtgtacagcagcatggagcggctctcactgctcgaggagcgccggacaccacccccgaccaagcgcagcctgagtgaggagaaggaggaccattcagatggcctggcagggctcaaaggccgagaccggagctgggtgattggctcccctgagatattacggaagcggctgtcggtgtctgagtcgtcccacacagagagtgactcaagccctccaatgacagtgcgacgccgctgctcaggcctcctggatgcgcctcggttcccggagggccctgaggaggccagcagcaccctcaggaggcaaccacaggagggtatatgggtcctgacacccccatctggagagggggtatctgggcctgtcactgaacactcaggggagcagcggccaaagctggatgaggaagctgttggccggagcagtggttccagtccagctatggagacccgaggccgtgggacctcacagctggctgagggagccacagccaaggccatcagtgacctggctgtgcgtagggcccgccaccggctgctctctggggactcaacagagaagcgcactgctcgccctgtcaacaaagtgatcaagtccgtctcagccacagccctctcactcctcattccttcggaacaccacacctgctccccgttggccagccccatgtccccacattctcagtcgtccaacccatcatcccgggactcttctccaagcagggacttcttgccagcccttggcagcatgaggcctcccatcatcatccaccgagctggcaagaagtatggcttcaccctgcgggccattcgcgtctacatgggtgactccgatgtctacaccgtgcaccatatggtgtggcacgtggaggatggaggtccggccagtgaggcagggcttcgtcaaggtgacctcatcacccatgtcaatggggaacctgtgcatggcctggtgcacacggaggtggtggagctgatcctgaagagtggaaacaaggtggccatttcaacaactcccctggagaacacatccattaaagtggggccagctcggaagggcagctacaaggccaagatggcccgaaggagcaagaggagccgcggcaaggatgggcaagaaagcagaaaaaggagctccctgttccgcaagatcaccaagcaagcatccctgctccacaccagccgcagcctttcttcccttaaccgctccttgtcatcaggggagagtgggccaggctctcccacacacagccacagcctttccccccgatctcccactcaaggctaccgggtgacccccgatgctgtgcattcagtgggagggaattcatcacagagcagctcccccagctccagcgtgcccagttccccagccggctctgggcacacacggcccagctccctccacggtctggcacccaagctccaacgccagtaccgctctccacggcgcaagtcagcaggcagcatcccactgtcaccactggcccacaccccttctcccccacccccaacagcttcacctcagcggtccccatcgcccctgtctggccatgtagcccaggcctttcccacaaagcttcacttgtcacctcccctgggcaggcaactctcacggcccaagagtgcggagccaccccgttcaccactactcaagagggtgcagtcggctgagaaactggcagcagcacttgccgcctctgagaagaagctagccacttctcgcaagcacagccttgacctgccccactctgaactaaagaaggaactgccgcccagggaagtgagccctctggaggtagttggagccaggagtgtgctgtctggcaagggggccctgccagggaagggggtgctgcagcctgctccctcacgggccctaggcaccctccggcaggaccgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggcccctaaaggagcaggagagagtggggaagaggatcctttcccgtccagagaccctaggagcctgggcccaatggtcccaagcctattgacagggatcacactggggcctcccagaatggaaagtcccagtggtccccacaggaggctcgggagcccacaagccattgaggaggctgccagctcctcctcagcaggccccaacctaggtcagtctggagccacagaccccatccctcctgaaggttgctggaaggcccagcacctccacacccaggcactaacagcactttctcccagcacttcgggactcacccccaccagcagttgctctcctcccagctccacctctgggaagctgagcatgtggtcctggaaatcccttattgagggcccagacagggcatccccaagcagaaaggcaaccatggcaggtgggctagccaacctccaggatttggaaaacacaactccagcccagcctaagaacctgtctcccagggagcaggggaagacacagccacctagtgcccccagactggcccatccatcttatgaggatcccagccagggctggctatgggagtctgagtgtgcacaagcagtgaaagaggatccagccctgagcatcacccaagtgcctgatgcctcaggtgacagaaggcaggacgttccatgccgaggctgccccctcacccagaagtctgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaaccatcaaaaaaaaaaaa

SEQ ID NO: 194 - DNA, 1688 bp, Homo sapiens
  CDS (73)..(1062)
cgtcctcgctgctcacatttcggcggagggcgcgctccctggaaaattccactcctgtgctagctccaccctatgcggcttttctcctacccgacgctcttcactctcagctcccttcccggcggcctttgcgggaacaagatggcagcccccatacctcaagggttctcttgtttatcgaggtttttgggctggtggtctcggcagccagttctggtgactcagtccgcagctatagttccagtaagaactaaaaaacgtttcacacctcctatttatcaacctaaatttaaaacagaaaaggagtttatgcaacatgcccggaaagcaggattggttattcctccagaaaaatcggaccgttccatacatctggcctgtacagctggtatatttgatgcctatgttcctcctgagggtgatgcacgcatatcatctctttcaaaggagggactgatagagagaactgaacgaatgaagaagactatggcatcacaagtgtcaatccggaggataaaagactatgatgccaactttaaaataaaggacttccctgaaaaagctaaggatatctttattgaagctcacctttgtctaaataactcagaccatgaccgacttcataccttggtaactgaacactgttttccagacatgacttgggacatcaaatataagaccgtccgctggagctttgtggaatctttagagccctctcatgttgttcaagttcgctgttcaagtatgatgaaccagggcaacgtgtacggccagatcaccgtacgcatgcacacccggcagactctggccatctatgaccggtttggccggttgatgtatggacaggaagatgtacccaaggatgtcctggagtatgttgtattcgaaaagcagttgacaaacccctatggaagctggagaatgcataccaagatcgttcccccatgggcaccccctaagcagcccatccttaagacggtgatgatccctggccctcagctgaaaccagaagaagaatatgaagaggcacaaggagaggcccagaagcctcagctagcctgatgacaaaaatgacttctagggtgaagcctgggtgatgaggctgctggaagctttgaagtctcccattcccctcatgctataaaaagaactacctttgttctctcccatcctgctcaggtcttttcagcagtctcatcatcagcaaccatgactgatgactgggccctagcaggtggcaggtataacatggccatggacactcttcttttttaaattttatgtctagcttctgagtctagatgaaagacagtatgtttcagagaacattggatatcagtttttcccacagcagggactgtgagagacaaccagcagcatcctctttgtaatcacagggcagggatcagagtttgaaatgaaatgttgtcagggtgttggaaaaattttggtgagttctgcacatttcccctggttcaggctgggcatggaccagccttcagatggcagaagtggaagatgagcctacttgtgagcgatgtgactttaaggaaatgaagactggggaagaataattagtgtttataagacatttaagaggccctttttcatatactgactcactgatgaatcagcatttgcattttatggaaaaatataaatccaaagaaataatttaaaaaaaaaaa

SEQ ID NO: 195 - DNA, 570 bp, Homo sapiens
  CDS (265)..(501)
gatgaggagccaacaaaaaagagcctcaggatccagcacacattatcacaaacttagtgtccatccatcactgctgaccctctccggacctgactccacccctgcagggacacaggtcagccttgaccaatgacttttaagtaccatggagaacagggggccagaacttcggcagtaaagaataaaaggccagacagagaggcagcagcacatatctgcttccgacacagctgcaatcactagcaagctctcaggcctggcatcatggtgcattttactgctgaggagaaggctgccgtcactagcctgtggagcaagatgaatgtggaagaggctggaggtgaagccttgggcagactcctcgttgtttacccctggacccagagattttttgacagctttggaaacctgtcgtctccctctgccatcctgggcaaccccaaggtcaaggcccatggcaagaaggtgctgacttcctttggagatgctattaaaacatgacacctcagccgctttgctagctagtcgctgcatttacaagctcattgatccgaacttagctccggtacg

SEQ ID NO: 196 - DNA, 1672 bp, Homo sapiens
  CDS (360)..(1415)
cgcagtccccgagcgagaccaaacaggtggaatccgggctggagccggagctccggcggcgcgggtggcggcacgtccctccagacagtaccacaggcacctggagtaccggcatcggtcgctgtggcccccgagtgtccgtcagagcctaggggagcctgccctcccgcgcctcgtcggggcccggccaggcaccttggccgccggcgcacggacgcgggcacgagcactagatcacggctgctggacctcggcacgttgacaagatttctctggggtaccgcggaggattactttgaatttcggtggtcgcctgtggtctggcatatttagaacttaagtctattatttcgggcaccatgactttgaggcttttagaagactggtgcagggggatggacatgaaccctcggaaagcgctattgattgccggcatctcccagagctgcagtgtggcagaaatcgaggaggctctgcaggctggtttagctcccttgggggagtacagactgcttggaaggatgttcaggagggatgagaacaggaaagtagccttagtagggcttactgcggagactagtcacgccctggtccctaaggagataccgggaaaagggggtatctggagagtgatctttaagccccctgacccagataatacatttttaagcagattaaatgaatttttagcgggagagggcatgacagtgggtgagttgagcagagctcttggacatgaaaatggctccttagacccagagcagggcatgatcccggaaatgtgggcccctatgttggcacaggcattagaggctcttcagcctgccctgcaatgcttgaagtataaaaagctgagagtgttctcgggcagggagtctccagaaccaggagaagaagaatttggacgctggatgtttcatactactcagatgataaaggcgtggcaggtgccagatgtagagaagagaaggcgattgctagagagccttcgaggcccagcacttgatgttattcgtgtcctcaagataaacaatcctttaattactgtcgatgaatgtctgcaggctcttgaggaggtatttggggttacagataatcctagggagttgcaggtcaaatatctaaccacttaccagaaggatgaggaaaagttgtcggcttatgtactaaggctggagcctttgttacagaagctggtacagagaggagcaattgagagagatgctgtgaatcaggcccgcctagaccaagtcattgctggggcagtccacaaaacaattcgcagagagcttaatctgccagaggatggcccagcccctggtttcttgcagttattggtactaataaaggattatgaggcagctgaggaggaggaggcccttctccaggcaatattggaaggtaatttcacctgagtctcagggaaccacgaagggatatggcaacgagtagagcatgaaggtagaacagtctatatactcttgtgacacatacaatccctaccttgtgctgccaagtaactcatttttgtgcaattctcagtataagccctttgtcgtttctatgcctatttaaagtctcctaaaggtgtaattgactaggaaggatgtagttctacactgccatttacctatttaaattcatccttgtgaatatctttgttgttgttgtt

SEQ ID NO: 197 - DNA, 1253 bp, Homo sapiens
  CDS (97)..(1077)
cctgcctctggtcggttcctggcgctctgcgtttcgtgaccttgtccagtagaaggctatttaattttcacaactgcttgaattttgacatacaagatgaagcaagatgcctcaagaaatgctgcctacactgtggattgtgaagattatgtgcatgtggtagaatttaatccctttgagaatggggattcaggaaacctaattgcatatggtggcaataattatgtggtcattggcacgtgtacgtttcaggaagaagaagcagacgttgaaggcattcagtataaaacacttcgaacatttcaccatggagtcagggttgatggcatagcttggagcccagagactagacttgattcattgcctccagtaatcaaattttgtacttcagctgctgatatgaaaattagattatttacttcagatcttcaggataaaaatgaatataaggttttagagggccataccgatttcattaatggtttggtgtttgatcccaaagaaggccaagaaattgcaagtgtgagtgacgatcacacctgcaggatttggaacttggaaggagtgcaaacagctcattttgttcttcattctcctggcatgagtgtgtgctggcatcctgaggagacttttaagctaatggttgcagagaagaatggaacaatccggttttatgatcttttggcccaacaggctattttatctcttgaatcagaacaagtgccattaatgtcagcacactggtgcttaaaaaacaccttcaaagttggagccgttgcaggaaatgattggttaatttgggatattactcggtccagttatcctcaaaataagagacctgttcacatggatcgagcctgcttattcaggtggtccacaattagtgaaaatctgtttgcaaccactggttatcctggcaaaatggcaagccagtttcaaattcatcatttaggacaccctcagcccatcctcatgggttctgtagccgttggatctggactgtcctggcatcgaactctccctctgtgtgtaattggaggagaccacaagctgttgttttgggtgactgaagtataaagtgttttctgtaccttagattcacaaactttgtatttttagtacatattttgaagaatttctatagtacatattttgaagaatttttatatcaaatataccgtatactttagaaaatgtctcagttgcttttattaaataaaatgttgatggtttgaaaaattaaaaaaaaaaaa

SEQ ID NO: 198 - DNA, 2875 bp, Homo sapiens
  CDS (114)..(2123)
tttcgtccgggcggcgtgcctgtggagcgctggtggcggcctggggctgagcatggagcaacgcggcggaggttgcctgcgaggccgctggccaggcctgagcctctgccaccatggccattgtgcagactctgccagtgccactggagcctgctcctgaagctgccactgccccacaagctccagtcatgggtagtgtgagcagccttatctcaggccggccctgtcccggggggccagctcctccccgccaccacggccctcctgggcccaccttcttccgccagcaggatggcctgctacggggtggctatgaggcacaggagccgctgtgcccagctgtgccccctaggaaggctgtccctgtcaccagcttcacctacatcaatgaggacttccggacagagtcaccccccagcccaagcagtgatgttgaggatgcccgagagcagcgggcacacaatgcccacctccgcggcccaccaccaaagctcatccctgtctctggaaagctggagaagaacatggagaagatcctgatccgcccaacagccttcaagccagtgctgcccaaacctcgaggggctccgtccctgcctagcttcatgggtcctcgggccaccgggctgtctgggagccagggcagcctgacgcagctgtttgggggccctgcctcctcctcctcctcttcctcctcctcttcagctgctgacaaacccctggcatttagtggctgggccagtggctgcccatcagggacgctatccgactctggccgaaactcactgtccagcctgcccacctacagcaccggaggtgccgagccaaccaccagctccccaggcgggcacctgccttcccatggctctgggcgaggggcactgcctgggccagcccgaggggtccctactgggccctcccactcagacagtggccggtcctcctccagcaagagcacaggctccctagggggccgtgtggctggggggcttttgggcagtggtactcgggcctcccctgacagcagctcctgtggggagcgctcaccaccacccccgcctccacctccttcggatgaggccctgctgcactgtgtcctggaaggaaagctccgagaccgggaggcagagcttcagcagctgcgggacagtctggacgagaatgaggctaccatgtgccaggcatacgaggagcggcagcggcactggcagcgagagcgtgaggccctgcgagaggactgtgcggcccaggcacagcgggcacagcgggcccaacagctgctgcagctgcaggtgttccagctgcagcaggagaagcggcaattgcaggacgacttcgcacagctgctgcaggagcgcgaacagctggagcggcgctgcgccaccttggagcgggagcagcgggagctcgggccgaggcttgaggagaccaagtgggaggtgtgccagaaatcaggcgagatctccctgctgaagcagcagctgaaagagtctcaggcagagctggtgcagaagggcagcgagctggtggctctgcgggtggcgctgcgggaggcccgtgctacgctgcgggtcagtgagggccgtgcgcggggtctacaggaggccgcccgagctcgggagctggagctggaagcctgttcccaggagctgcagcgacaccgccaggaagctgagcagctgcgggagaaagctgggcagttggatgctgaggcggccggactccgggagccccctgtgccacctgccaccgctgacccattcctcctggcagagagtgatgaggccaaagtgcagcgggcagcagccggggttgggggcagcttgcgggcccaggtggagcgattgcgggtggagctgcagcgggagcggcggcggggtgaggagcagcgggacagctttgagggggagcggctggcctggcaggcagagaaggagcaggtgatccgctaccagaagcagctgcagcacaactacatccagatgtaccggcgcaaccggcagctagagcaggagctgcagcagctcagcctggagctggaggcccgggagctcgctgacctgggcctggccgagcaggccccctgcatctgcctggaggagatcactgctactgagatctagggccctcagcaaccagctctgtagggagctctgccagaggggcagcagctgcagatccacttaggccccagggtccacggatggccccaaaggctgagggccccaaagccacttgtctcctaggatccaggcctctgggcttctgccaagaactcagggtggccctatgacttggaggagcaagatcagaccgctcaaaggtccccgtgttcactgttacccagaggctcttgttactacccacttcattccccaccgctgccagtgccactgccaaccctgttcacaggcgcttccagcccactccagccaggggagcagggaagaagaaggggctccctcctcttcacattccccccgaccccaaagccagagaaagccagatggcaccagctgctccggatgtgcctgcccacattgggggacagggccgggcctgggcagctggtgccatctggagcagctggtgccagctgctccggatgtgcctgcccacattgggggacagggccgggcctgggctcggttcccaggtttgagctctgcagcctctctcctggagtgagggggctgaagtcagaccaaaggaagaactcagaaatgtcttgtttatttgtgtttgtgaccaagcagcctctcccttcacccaggtttatggcctcgttttcacttgtatatttttcacactgtaaatttcttgtacaaacccaaagaaaaaattaaaaaaaatttttttgtttaaaaaaaaaaaa

SEQ ID NO: 199 - DNA, 1452 bp, Homo sapiens
  CDS (35)..(1270)
ctcgggggcggcgctcagaaaacatctggagaaaatgacccattggtttcataggaacccattaaaagccacagctcctgtgtcttttaattactatggtgtagtcactggcccttctgcttcaaaaatatgcaatgacttgaggtcatccagggcacgactccttgaactgttcactgatttgagctgtaatccagaaatgatgaagaatgcagcagattcatatttctcacttttacaaggtttcataaattctttggatgaatctacccaagaaagcaagttacgatatattcaaaatttcaagtggactgatacattgcaaggacaggttccaagtgcccagcaggatgctgtttttgaattaatttccatgggatttaatgtagctttatggtataccaaatatgcttcaagactggctggaaaagaaaatataacagaagatgaagcaaaagaagttcatcgaagcctaaagattgcagctgggatttttaaacatttaaaggaaagtcatctcccaaaactcattacacctgcggaaaaaggaagagatttagagtcacgactcatagaagcatacgttattcaatgtcaggctgaagctcaagaagtaacaattgctcgagcaattgaactaaaacatgctcctggactaattgctgcactggcgtatgaaacagccaatttctatcaaaaagctgatcatactttatccagtttggagcctgcatattctgccaaatggagaaaatatcttcacttgaagatgtgtttctacacagcttatgcttactgttaccatggtgagactttattggctagtgataaatgcggtgaagcaatcaggtctctccaagaagcagaaaaattgtatgcaaaggcagaagcactgtgtaaagaatatggagaaaccaaaggacctggaccaacagtcaaaccttcaggacatctgttctttaggaaacttggaaaccttgtgaagaacaccctagaaaaatgtcagagagaaaatggatttatttactttcaaaaaattccaacagaagccccacagctggaactcaaagcaaattatggtctcgtagagcctatacctttcgaatttcctcctacaagtgttcagtggacaccagaaacattggctgcatttgatctcaccaaaagacccaaggatgacagtactaaacccaaaccagaagaagaagtgaaacctgtgaaagaaccagacatcaaacctcaaaaggacactgggtgctacatctcctaaaatacaacttgcacttagaatttctctagcagtaaataagataaaccacagaatttcagttcttatttctcaaaatgatttctctgaagcttgtagaataactattattcagagggttatctgccttcagcttacttgttcttaatttttaatacagcggagatgtttcttgaaaaaaaaaa

SEQ ID NO: 200 - DNA, 1250 bp, Homo sapiens
  CDS (84)..(917)
atggggaagtggaagcgccgggccctgctgcgggggggagagccactgacgccgggaccgggaccgccgccgccgccgccaccatgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgagatctattgatgctatccctgacaaccaaaagtttaagcagttgcagagggagctctctcaagtgctgacccagcgccagatctacatccagcctgataattaagccgatccaggtaccctgcctgagagccgcgagaccctccccactaaaacaggactcaccaacccgccgagaccctgccggtccggctgctgctccgcggccatttaaaccaccactaacccccacgtgtgctcccggtcggtgcacagccacattcccgtgtagcctcggccccatgtaacacggcacctatcacgtgtgtgtgctttccactctgggtggaggctgggtgtggggaagacggctgattttttggcttttgcttctgaagaagcccaggccaagggacggatgctgcctctccagcagcagccacttgtgtgcaccggcctg

SEQ ID NO: 201 - DNA, 4015 bp, Homo sapiens
  CDS (314)..(2167)
aagcttgcggccgcaggcggagcagggcggcccgggcggcggtggggacaacggtttccctttgaaggggacggacaaagcccgagtgaccagcggcggcggggaggactagtccccgggcagtttggtgccctggttgtcagatgttggaaagcagtaggacggaacatactcttcgtggttgtgtatccgttctggggtgcagcaattaacattggactttggttcctgtgactcttgcctgtgtcgatagagttaaactggagctctgctttgaaagataaataaagcacagcctctcaactggacataaatggatctaaagacagcagtatttaacgcagctcgggatggcaaactccggcttctcaccaaattgttggcaagcaaatccaaagaggaggtttcctccttgatctctgaaaaaacaaatggggccacgccactcttgatggccgccaggtatgggcaccttgacatggtggaattcctcctagagcaatgcagtgcctccatagaagttgggggctccgtcaattttgatggcgaaaccattgagggggctccccctttatgggccgcttctgcagcaggacatctgaaggtggtccagtccttgttaaatcatggagcatctgtcaacaacacgactttaaccaattcaactcctcttcgagctgcgtgtttcgatggccatttggaaatagtgaagtaccttgtagaacacaaagctgatttggaagtgtcaaaccgacatgggcatacgtgcttgatgatttcatgttacaaaggacataaagagattgctcagtatttacttgaaaagggggcagatgttaatagaaaaagtgtcaaaggtaatactgcattgcatgattgtgcagaatctggaagtttggacatcatgaagatgcttcttatgtattgtgccaagatggaaaaggatggttatggaatgactccccttctctcagcaagtgtgactggtcacacaaatattgtggattttctgacacaccatgcacagaccagcaagacagaacgtattaatgctctagagcttctgggagctacatttgtagacaaaaaaagagatctgcttggggctttgaaatactggaaaaaggcaatgaacatgaggtacagtgataggactaatattattagtaaaccagtgccacagacactaataatggcttatgattatgccaaggaagtgaacagtgcagaagagctagaaggtcttattgctgatcctgatgagatgagaatgcaggcactattaatcagagaacgtattcttggtccttctcatcctgatacctcttactatattagatatagaggcgctgtctatgcagactctggaaatttcaaacgatgcatcaacctatggaagtatgctttggatatgcagcagagcaatttggatcctttaagcccaatgaccgccagcagcttattatcttttgcagaactattctcctttatgctacaggatagggctaaaggcctgctgggtactactgttacatttgatgatcttatgggcatactttgcaaaagcgtccttgaaatagagcgagctatcaaacaaactcagtgtccagctgacccattacagttaaataaggccctttctattattttgcacttaatttgcttgttagagaaagttccttgtactctagaacaagaccatttcaaaaagcagactatatacaggtttcttaagctgcatccaaggggaaagaataacttcagccctcttcatctggctgtggacaagaatactacatgtgtagggcggtaccctgtttgtaaatttccatctctacaagttactgcaatactgatagaatgtggtgctgatgtgaacgtcagagactcggatgacaacagtcccctgcatatcgctgctcttaacaaccatccagacatcatgaatctccttattaaatcaggtgcacattttgatgccacaaacttgcacaaacaaactgctagtgacttgctggatgagaaggaaatagctaaaaatttaatccagcctataaatcataccacattgcagtgtcttgctgctcgtgtcatagtgaatcatagaatatattataaagggcatatcccagaaaagctagagacttttgtttcccttcatagatgataacttgactgtattttagcactgttaaagcacgaattggtaacagttgtttcataaatgagcactgttgtgataacaccagcattcatttagcttgattgatatcattgtgctctcattggctaaagcattataagcatcaaatttacaacattggtttcccaatatttaatataaatataccatataatatattgtttgtgaattattgagaaatgtaacattcaaatttctaaaattgtctgccaaaggcttattcattctggttttgtttgctgttgggtgtttggggcaaagttaaccatttctccatggtgtctttatactttactggtttgtgaattttatacaattgaaagtctttttttcttgcttctttcttctcttctcaagtttcccccctgtttctactttattgtttgtcctaaccatttctactacagttttttccttatggacccatactaggttgtacaaaccttaaggactcgttaccatttgcagttaccataagtgctttatcttctctatgcacaggcttaaacttgactgttgtatgttagcatattttctatgcagcagttggtcaacttcaactcaaaacactgttttcttatgtttgttacaaacttaattttttgaaagtactctgtagcatgacaatttttagagctgcaggttagctattatagctcaagcttttttgtttgtttttttcttcactttcttcacatctgaggtttctttctctaatccactgaaattattgtgtgctaaatttgggaaacagatctattctaactcattaacccagttgaaatttaggtctgtcatcttaatatatcatgcagtaaaaggaagaatctttttaaagtgacccacctttcatgctgctccagcattgtcctgcttgtgctgatggtgtgattaggtgtagagaatttgcttaaatttaacttcaaagttcatcacacagcttaatgagtcacattgaaatactcagtaattgaactgcaaatcacttttagttacaaaaagagctaaagcatgtcagtggcatgatgcttgccaagccagatctaggcatctaggataattaaggtattttagtatgcaatttactgccataatatcaaaggtcagtaacagtgttctttctttcttcaagcttatgtatacctttaaagataacttgcatgaattactttgattactttggtctcaattatttgtcaccccagttaaacatgaaaggttgcagtgcttcctgttcccttactggaagttagctttttcttttctctttcttcctttctttctctcactctttctttctctttctctttctctctctctctctctctcactcactcactcacagatttgctaatgccacagaaagggctcttttaacttaagataagtgaaaagtactaaaaaagattcaggtaattatcattcagcactttattgtaattcagaataaaatttatgatggcatatttgccctgcaaatgtcttaatgaagttgttctcaataaaaagctccttattgatttgagaaaaactcagtttacctgtgagttcaatgagctggatcactcacttggatttttgtgttgacattttattctgagggttgatgttacactatttaaggagtcatcaatgcaaacagtcacattaggtatgtcatcatctttagtcagtaaaaaccttgtaatgaggagtagtaaataaacaagagaacattagactttttggttaaataattgagatttaatttttaaaagatattcttactcatttgctaggttgtaaatttgatttcaccattaagaaaagggt

SEQ ID NO: 202 - DNA, 1079 bp, Homo sapiens
  CDS (383)..(610)
gcttacagggtcttcacatgcttactagctacagttacgtcacttaatcatgtgtaataaatggctcgtgtaattttgagtcacttaaagtgatcagattgttttaattgtgaagcatgtgaataaataaatgagatttccaccgtctggtactatatacgtaaaactagaggctttgcaaaattaccaagagacgatcccgtttgatgtgtctttggtttggcacaggtggagcagacatgtgagatatagaatgaatgggaggccttcacacttactcactatgtggaaggtggtagttgatcatgatggtcagttccataggcctccaggccactggtgacacactaccactgttgccataattcttaaaagtcattttatgtggggctccttcctagcaacctccctcaaacacatagctccatcccttccaagagctaagaaatttttagcacttgccaccatctatttgttcatttgtttactgattacattcctcccattagtatataagctccgtgataatagaaactttgtccactattgtatatttctaactcctaagacactattggcgtattatagtatgcagttaatactagaataaatgggatttctgtttgttcttactgaggtttgcaaagcttcatgaaagtggaatataaagattctcgttgttctgtgtgcattggggacatggaacggaacttgtgttttctgagtgagggagcctctggcagagagtctaactgcaatccattattccctgtgactgggcagaatttaaaaatttttaagagaagagatgaaaaatcttctggattcctacttaatttagacatgggtttggctcttaacgaaaaactttaacctacctacagggaaggctttttcgctgttacccttacttctgtctcctggatcttatgagtggagaaatgagcctttgtttcacttacaaatccacaaatatttatgctgtcatatgaacacatgtataaggcgctgtgtcacattgtggaagatacaaagagacaggattcctgagatcgtagctacgttaagcatgagtgtta

SEQ ID NO: 203 - DNA, 2796 bp, Homo sapiens
  CDS (175)..(1461)
tttcgtctctctgtcagtggcggctgctgcctgctctggaggcaggctgggcggtggcggccgagactggcgggggtggacgcccgggccgggctgcgcccgcttcttgcagctgtgaattcctttggacaattgatgatatttatcattgtgcccagtttctacaaataaaagatgggtggattattttctcgatggaggacaaaaccttcaactgtagaagttctagaaagtatagataaggaaattcaagcattggaagaatttagggaaaaaaatcagagattacaaaaattatgggttggaagattaattctgtattcctcagttctctatctgtttacatgcttaattgtatatttgtggtatcttcctgatgaatttacagcaagacttgccatgacactcccattttttgcttttccattgatcatctggagcataagaacagtaattattttcttcttttccaagagaacagaaagaaataatgaagcattggatgatttaaaatcccagaggaaaaaaatacttgaagaagtcatggaaaaagaaacttacaagacggctaaattaattcttgaaaggtttgatccggactcaaagaaagcaaaggagtgtgagccgccatctgctggagcagctgtaactgcaagacctggacaagagattcgtcagcgaactgcagctcaaagaaacctttctccaacaccagcaagccctaaccagggccctcctccacaagttccagtatctcctggaccaccaaaggacagttctgcccctggtggacccccagaaaggactgttactccagccctatcatcaaatgtgttaccaagacatcttggatcccctgctacttcagtgcctggaatgggtcttcatcctccaggtccacctttagcaagacctattctcccccgagaacgaggtgctttggatagaattgttgaatatttggttggtgatggtccacaaaacaggtatgcacttatatgtcagcagtgtttttctcataatggcatggctttgaaggaagaatttgaatacattgcttttcgatgtgcctactgttttttcttgaaccctgcaagaaaaaccagacctcaggctccaagacttcctgagtttagttttgagaagaggcaggtggtggaaggttcaagttcagttggtcccttgccatcaggaagtgtgctttcatcagacaaccagtttaatgaagaatctttagaacacgatgttcttgatgataatacagagcagacagatgacaaaataccagctacagaacagacaaaccaagtgattgaaaaagcatctgactcagaggaaccagaggagaaacaagagactgagaatgaggaagcctcagtgattgaaaccaactccacagttcctggagctgattctattcctgatcctgaactaagtggagaatctttgacggcagagtagtaaatgcttccacgtgccttcaactggatatttatagtcttactgatgtcagttattgctttttcggtggcacttactttttttgcccctctaagggtatgcttgtgtatcatttgaattcagattgcctagctatttgaacatctcaaagttatatatactgggtattaaaattaaaagcaagttatatcagtgaagtaagatccttttgaatgtacaaagacccacactattgagacagcttttagatacttttttgtccattctaaaagtaagcaaacatgattgccttcttgttttctgtatgtataacccgtaaatatccattttgacataggaagaactttggttaagagtaagttctctaattgtgtttgttttaaggaatgaaacttggttaagattttgactacttcattattaaaaattgatagaattttagctcctgagatatttacaactgggagaaatgtctatttaggtgtttacattaagcggtatgaaagttgttaccacataggcactggtacgaattctcaataagaatgcagtggaacagttaagtagaactgtaactacgttggcactggtacgaattctcagtgagaatgcaatgaaacagtcaactgcagtgtttctttttgatgtcttttattttacaactgggccaaaggcacattatgtatataattagtttatatttacacactagcatataggaaatatttctgcacttgaccctatttgaattctgagcattatttataagtataaaatgatgatatataagtgaattttgtgctcttgtttgtattttattaaggaaaatgaaaataatctggcatcagtttcattttgctaaatatctagtcttcttcaaacagtatcttggtgggtgacttggctacctgaaaaatcttaggaggaatagctcacaatacaataaatctgtagattctgcttagagcaaattatggtacttttattcagacttgtttcctttctagttaacagaaatagtgacatttagaggttttaatcagaagttaggtttttctgattcaggaacatcgtaggccagccatttgtaatttttaactttgagaaacaaattttgtgagaataggtagtgggttgctggtagttaattggatttaatatttgtattaaggattaactggaaaaaatgtgtctcagtgctaattcttggacctttaatacagtgtgcttatctgttacggcctccttttatctctcttctccaatattaaaaaaaatggaaatcaaattattatgctgaagggaaaaatatacctgtataagaaaaaaaaaaaa

SEQ ID NO: 204 - DNA, 2200 bp, Homo sapiens
  CDS (424)..(1812)
gaatttcggcacgagagctattgtgtttttaaggatgccacaggcacaaacgggggaatatgccctccttttttaacatgggggggtgtttttagaccagtccaacattaggaatttctcttgcttaaattaaaggtgctccagacaaattaaacatccaaatctggtatatccaggtacccgtgattcctttggcaagggtagtttcttggaggggaagatcgattaattttttcggagaaggaaagagaattaccagactgaactgttgggaacaattggctgagcaacgagggaacaagcgacggtaatgaaagagaaaaagatttagaactcagggttgcagcgtctggagcacaagaccctgagaaatcgcctgatagactaaagcagtttagtgtggcaccaagacactttgaagagatgataccacctgaaagacccagaatagctttccagacacctctcccgcctttatctgccccatctgtcccacccatcccatcagttcatcctgttccttctcaaaatgaagatttgcgcagtggactcagcagcgcccttggtgaaatggtgtctcccaggattgcacctctgcctccacctcccctactaccacctttggctactaactatcgaactccttatgatgatgcatactatttttatgggtccaggaatactttcgatcccagtcttgcttattatggttcaggaatgatgggcgtacagcctgcagcttatgttagtgctcctgtcacccaccaactagcacaacctgttgtgaatacggttggacagaatgaactgaagattacaagtgatcaagtgataaattcaggattgatttttgaagataaaccgaaaccttccaaacagtcacttcagtcttaccaagaggctttgcagcagcagattcgggaaagagaagaaagaaggaagaaagaacgtgaagaaaaagaagaatatgaagctaaattagaagctgaaatgagaacatataatccctggggaaaaggtggaggtggtgctcctctcagggatgcaaaaggaaatctgataactgatttgaataggatgcacagacaaaatatagatgcctaccataacccagatgcaagaacatatgaagataaaagggctgttgtatctctagacccaaatttagccacttcaaatgctgagaacctagaagatgctgcaaataaaagctcaggtcatatgcaaacacagagctctccttttgctcggggaaatgtatttggtgagcctccaactgaacttcagattaaacagcaagaattatacaagaattttcttcgtttccagattgaggaaaagaaacaaagagaggaagcagagcgagagagactgagaattgcagaagaaaaagaagaaagacggcttgcagaacagagggcacgaattcagcaggagtatgaagaggaacaggaaaagaaaagagagaaagaggaggagcaaaggctaaaaaatgaagagcatattcggttagctgaagaaagacaaaaagaagcagaaagaaagaagaaagaagaagaagaaaaatataacctgcaacttcagcactactgtgaaagagacaatttgattggggaagaaacaaagcacatgagacagccttctcctatagttcctgctcttcagaacaaaattgcaagcaaactccaaagacctccttcagttgacagcatcatacgttcctttattcatgaaagttccgttgaagccgtcgacggcttcaacggaactttacacgtgattcttctgcacacagtattgaagagcaactagattaaattctagtttacaaaattaccagttttcttcaagaactaaatgatatgtccttttttttttttcaaaaaggaaaagggcggcttttaaaaaaaaaaaccaaagggaaagggaaaaggggacccggttcattccaccacctttttaattggccccggattggccccccacccggcggcctttggattggattcggggacccagaactttaaatcggttaccaaacaatccggggttaaaccccaaaagggccaaaccggcaaaagggcggcgggtaaacaatccaaaaagccttgggaccggggccaaagtgaaagaaggaacttaaaaaaaccggttcttaaacctcttaaaacttaaaaaaccttggttaaaaaaaaaaaaa

SEQ ID NO: 205 - DNA, 2000 bp, Homo sapiens
  CDS (71)..(1738)
tttcgtggagcgcaggcagcagcactttatctgcgactctccagcccagcgagaggcgaagcggtttaccatggaacccgtgaccaagtggagccccaaacaagtggtggactggactagagggttggatgactgcctgcaacaatatgtccacaagtttgaacgagagaagatcaacggcgagcagctgctgcagatttcccatcaggacctggaggagctgggggtcacacggatcggacaccaggagcttgtgttggaggctgtggaccttctctgtgcactgaattatggcctcgaaactgataacatgaagaacttggttctgaaactgagagcatcttcccacaatttacagaattacataagtagccgacggaaaagtcccgcttacgatggcaacacctcccgcaaggcccccaatgagttcctgacctcggtggtggagctcatcggcgccgccaaggccctgctggcgtggctggaccgggctccgtttacagggatcactgatttctcagtcacgaagaacaaaattatccagctttgcttggacctgaccactacagtccagaaggattgctttgtagcggaaatggaggataaagttttaactgtggtcaaggttttaaatggcatctgtgacaaaacaatccgatctaccacagatcctgtgatgagccagtgtgcatgtctggaggaagttcacttaccaaacattaaacctggggaaggcctgggcatgtacatcaaatcaacctatgatgggttacacgtgattactggaaccacagaaaattctcctgcagacagatctcagaagattcatgctggtgacgaagtcattcaagttaatcagcaaactgtggtgggatggcagctgaaaaatctggtgaagaaattgagagagaatcccaccggagttgtgttactgcttaagaagcgccccaccgggtctttcaactttactcctgctcccctgaaaaacctacggtggaagccacctcttgtacagacctcacctccacccgcgacaacccagtcccctgaaagcactatggatacctcactgaagaaggagaagtcagccatcctggatctttatattcctcctccgcctgctgttccctactctccccgggatgagaatggcagttttgtttatggagggtccagtaagtgcaaacaaccattgcctggtcctaagggttcagagtccccgaattccttcttggaccaggaaagccggagacgaagattcaccattgcagactcggatcagttgcctgggtactcggtggaaaccaacattctgcccacaaaaatgagagagaaaacaccatcttatggcaagccacggcctttgtccatgcctgctgatgggaactggatggggattgtggacccttttgccagacctcgaggtcatggcaggaaaggggaggatgccctttgccggtatttcagtaacgagcggattcctccgatcattgaagagagctcctctcccccataccggttctccagacccacgaccgagcggcatctggtccggggtgcggactacatccgaggaagcaggtgctacatcaactcagatctccacagcagcgccacgattccattccaggaggaagggaccaaaaagaaatctggctcctcagctacgaagtcctcgtccacagaaccgtccctcctggtcagctggtttacgcgcctcaaactgttgactcactgagagggaccctgctcaggccacctgcctggctcctgccccaagtgccttgcttttacagtggacagcctcttctcgtttcggcctcagtattatgtagggaccttatgcaatttctttttcttttgaaaagttatctactgcccttcttggaagtttgcaggattggatgggaacaaattcagaggatcttaggtgttggcttgtggagacaaaaggagggaaatgggtagagcctgtttgtcttgcttccccagaatgtatt

SEQ ID NO: 206 - DNA, 1234 bp, Homo sapiens
  CDS (71)..(781)
tttcgtggagcgcaggcagcagcactttatctgcgactctccagcccagcgagaggcgaagcggtttaccatggaacccgtgaccaagtggagccccaaacaagtggtggactggactagagggttggatgactgcctgcaacaatatgtccacaagtttgaacgagagaagatcaacggcgagcagctgctgcagatttcccatcaggacctggaggagctgggggtcacacggatcggacaccaggagcttgtgttggaggctgtggaccttctctgtgcactgaattatggcctcgaaactgataacatgaagaacttggttctgaaactgagagcatcttcccacaatttacagaattacataagtagccgacggaaaagtcccgcttacgatggcaacacctcccgcaaggcccccaatgagttcctgacctcggtggtggagctcatcggcgccgccaaggccctgctggcgtggctggaccgggctccgtttacagggatcactgatttctcagtcacgaagaacaaaattatccagctttgcttggacctgaccactacagtccagaaggattgctttgtagcggaaatggaggataaagttttaactgtggtcaaggttttaaatggcatctgtgacaaaacaatccgatctaccacagatcctgtgatgagccagtgtgccctctggagagcagctttggtgtttgccaatacagaacacaaacagaaattaatgctaatggaaatgtctgatcaactatttctcaggtaggcttttagaaataaaactaacagttgaaataagatttacaaaaaccaagcactgaggtacttccttagaaactagtcacaaagcggagaatcagttctcatgggaatttcctcctgagatctttctctcccattcctcagcccagcactgaaaccttggtagcggtgctgaagctgagtaggattgggagggtgcaccaagcctgcctccaaaatagtggtctccagtttatgttttaagtgctactctaaatggaaaaagtatgctgaagagcctagacactgtatctccactagaaatcctggggagagagagcggctgaaaacctagcaaaggttggctcactggtgccagccccaggatgtcggagatgctgaacatcatgttgagtgtgtgtctcccagtgtgtcacagtagacgaaatcgtcgacagcccgggaattccggagcggt

SEQ ID NO: 207 - DNA, 1931 bp, Homo sapiens
  CDS (71)..(1669)
tttcgtggagcgcaggcagcagcactttatctgcgactctccagcccagcgagaggcgaagcggtttaccatggaacccgtgaccaagtggagccccaaacaagtggtggactggactagagggttggatgactgcctgcaacaatatgtccacaagtttgaacgagagaagatcaacggcgagcagctgctgcagatttcccatcaggacctggaggagctgggggtcacacggatcggacaccaggagcttgtgttggaggctgtggaccttctctgtgcactgaattatggcctcgaaactgataacatgaagaacttggttctgaaactgagagcatcttcccacaatttacagaattacataagtagccgacggaaaagtcccgcttacgatggcaacacctcccgcaaggcccccaatgagttcctgacctcggtggtggagctcatcggcgccgccaaggccctgctggcgtggctggaccgggctccgtttacagggatcactgatttctcagtcacgaagaacaaaattatccagctttgcttggacctgaccactacagtccagaaggattgctttgtagcggaaatggaggataaagttttaactgtggtcaaggttttaaatggcatctgtgacaaaacaatccgatctaccacagatcctgtgatgagccagtgtgcatgtctggaggaagttcacttaccaaacattaaacctggggaaggcctgggcatgtacatcaaatcaacctatgatgggttacacgtgattactggaaccacagaaaatgtgggatggcagctgaaaaatctggtgaagaaattgagagagaatcccaccggagttgtgttactgcttaagaagcgccccaccgggtctttcaactttactcctgctcccctgaaaaacctacggtggaagccacctcttgtacagacctcacctccacccgcgacaacccagtcccctgaaagcactatggatacctcactgaagaaggagaagtcagccatcctggatctttatattcctcctccgcctgctgttccctactctccccgggatgagaatggcagttttgtttatggagggtccagtaagtgcaaacaaccattgcctggtcctaagggttcagagtccccgaattccttcttggaccaggaaagccggagacgaagattcaccattgcagactcggatcagttgcctgggtactcggtggaaaccaacattctgcccacaaaaatgagagagaaaacaccatcttatggcaagccacggcctttgtccatgcctgctgatgggaactggatggggattgtggacccttttgccagacctcgaggtcatggcaggaaaggggaggatgccctttgccggtatttcagtaacgagcggattcctccgatcattgaagagagctcctctcccccataccggttctccagacccacgaccgagcggcatctggtccggggtgcggactacatccgaggaagcaggtgctacatcaactcagatctccacagcagcgccacgattccattccaggaggaagggaccaaaaagaaatctggctcctcagctacgaagtcctcgtccacagaaccgtccctcctggtcagctggtttacgcgcctcaaactgttgactcactgagagggaccctgctcaggccacctgcctggctcctgccccaagtgccttgcttttacagtggacagcctcttctcgtttcggcctcagtattatgtagggaccttatgcaatttctttttcttttgaaaagttatctactgcccttcttggaagtttgcaggattggatgggaacaaattcagaggatcttaggtgttggcttgtggagacaaaaggagggaaatgggtagagcctgtttgtcttgcttccccagaatgtatt

SEQ ID NO: 208 - DNA, 6736 bp, Homo sapiens
  CDS (827)..(6172)
  misc_feature (1)...(6736): n = a,t,c or g
gcagtccatggagcataacctagccctggtggcctagaaggaaggaagggcaggcagagtgtagatagttcattctgccttgagttggtggggttagtgataaccctgctgtcttttgccttaggagagaaacaagaatgctgctcaggagctggccactttgctgttgtccctgccagcacctgccagtgtccagcagcagtccaagagccttctggccagcctgcacaccagccgctcggcctaccacagccacaaggtaactgttctctcagggaaaggaaattgcagtgctgacagggaatcaaataagttagcttttcattgtaaagcaacagcacagcaaagtaaggtagagggaggatagcattcagattagacctacattttacagagtttctcctgaganattctcaagtgccactcanaaccgagggtaagccagtgactgggcccctggtttgtacttatttttctgtcactctaacaggatcaacaagacttaagaaagagaaggagggatattgagcacgatgacagtgagcctattttggggcaatggtttgaggagactatttctcccagtaaagagaaagcagcacctccgcctcctcccccacctcctccactggaaagctctcctcgggttaaaagccccagtaagcaggcccctggtgagaagggcaacattctggcgagtcgcaaagatcctgagttgttcttaggtctggcttccaacattttgaacttcatcacctcttccatgctgaactctcggaacaattttatccgaaactatctgagtgtatctctttcagaacaccatatggccaccctagccagtatcatcaaggaggtggacaaagatggactcaagggttcatcagatgaagagtttgctgcagctctctatcacttcaaccactcactggtaacctctgaccttcagtcacctaacctgcagaacacactgttgcagcagctaggagtggctcctttttctgagggcccttggcccttgtacattcaccctcaaagcctctctgtgctttcacgcctcctgctcatctggcaacataaagccagtgctcaaggtgaccctgacgtcccagaatgccttaaagtttgggacaggtttttgtctacaatgaagcagaatgccctgcaaggtgtggtgcccagtgagacagaggatctgaatgtagaacacctgcagatgctcctcctcattttccacaatttcaccgagacaggccggcgggccatattgtcgctttttgtccagatcatccaggagttgagcgtcaacatggatgctcagatgcgcttcgtgccgcttatcttggctcgcctccttctcatctttgattatctgcttcatcagtactccaaagcccctgtgtatctatttgagcaggtacagcataacctgctaagtcctccctttgggtgggcaagtggatcccaggacagcaacagccgccgggcaaccactcctctctatcatggattcaaagaagtagaagaaaactggtctaagcatttctcatcagatgctgtcccacaccccagattctactgtgtcctgtccccagaagcctcagaggatgatttgaaccgacttgattctgtggcatgtgacgtccttttttccaagcttgtcaagtatgatgagctttatgctgcactgacagccctgcttgcagctgggtcccagcttgatacagttaggagaaaggaaaacaagaatgtaacagccttggaggcctgtgcccttcaatattacttcttgatactgtggaggatcctaggaattttaccaccatcaaagacttacattaaccagctatccatgaactcacctgagatgagcgaatgtgacatcttgcacactctgcgatggtcttctcggctccggatcagctcctatgtcaactggataaaggatcaccttatcaaacagggaatgaaggctgagcatgctagctcgcttctagaactggcatccaccactaagtgtagctcagtgaaatatgatgttgaaatagtagaggaatacttcgctcgacagatctcatccttctgtagtatcgactgtaccaccatcttgcagctgcatgaaattcccagtctgcagtccatctacacccttgatgccgcgatctcaaaggtccaggtctctttggatgagcatttttctaagatggctgctgagactgatcctcataagtcgtctgagattaccaagaacctacttccagccacgctgcaactcattgacacctatgcatcgttcaccagagcctatttgctgcaaaactttaatgaagagggaacaactgagaaaccttccaaggagaaactgcaaggctttgctgctgttttggctattggctctagcaggtgcaaggcaaatactctgggtccgacactggttcagaatttgccatcgtcagtgcagactgtgtgtgagtcctggaacaacatcaataccaatgaatttcccaatattggatcctggcgcaatgcctttgccaatgacaccatcccttcagagagttatattagtgcagtgcaggctgcacacctggggactctctgtagccaaagtctgcccctggctgcttccctgaagcataccctcctctcactggtcaggttgactggagatcttattgtttggtcagatgagatgaacccaccacaggtaattcggacactgctacctcttcttttggaatcaagcactgagagtgttgccgagatcagtagcaactccctggaacgcatcttgggccctgctgagtctgatgagttcttggctcgtgtttatgagaagctgatcactggttgttacaacattctggccaatcatgcagatcctaacagtggactggatgaatccatcctggaggaatgtctccagtacttggaaaagcagctggaaagtagccaggctcgtaaagctatggaggagtttttctctgacagtggagaacttgtacagatcatgatggcaacagccaatgagaacctctctgctaaattctgtaaccgagttttgaaattcttcaccaaactcttccagctgactgagaagagccctaacccgagcctgttgcatctttgtggctccctggcacaactggcctgtgtggaacctgtgcgcctgcaggcctggctcacccgcatgactacatcgcccccaaaagattctgatcagctggatgtaattcaggagaaccggcagctgctgcagttactgaccacatacattgttcgggaaaacagccaagttggggaaggtgtgtgtgctgttcttctgggcaccctgactcccatggcaacagagatgctggccaacggtgatgggactggcttccctgaacttatggttgtgatggccactctggccagtgcaggtcaaggtgctggtcaccttcagcttcataatgctgctgtggattggctgagcagatgcaagaaatacctgtcacagaagaatgtagttgaaaaactgaatgccaatgtaatgcatggaaagcatgtgatgatcttggagtgcacatgccatatcatgtcttacttggctgatgtcacgaatgccctgagccagagtaatggtcaaggcccaagtcatctctcagtggatggggaagagcgggccattgaagtagactcagactgggtggaggagttggcggtggaagaggaagattcccaggctgaggattcagatgaagattctctttgcaataaactctgcacttttacgatcacacagaaagaattcatgaaccagcattggtaccactgtcacacctgtaaaatggtggatggcgtgggtgtctgcacagtgtgtgctaaggtgtgccacaaggatcatgagatttcctatgccaagtatggatccttcttctgtgactgtggagccaaggaagatggcagctgtttggctctggtgaagagaactcctagcagtggcatgagctctaccatgaaggagtcggcatttcagagtgaacccaggatttcagagagtctagtgcgtcatgccagcacctcctcgccagctgacaaagccaaggttaccatcagtgatggaaaggttgctgacgaagagaagcccaagaagagcagcctctgccgcacagtagagggctgccgggaggaattacagaaccaggccaatttctccttcgctcctctcgtgttagacatgcttaatttccttatggatgccattcagaccaacttccagcaagcttcagccgtcgggagcagcagccgtgctcagcaagccctcagtgagctacacactgtggagaaggcagtggagatgacagaccagctgatggttcccaccttagggtcccaggaaggtgcctttgagaatgtgcggatgaattacagtggagaccagggccagaccatccggcagctgatcagtgctcatgtgctcaggcgggtggctatgtgtgtgctctcctctccccatgggcgccgccaacatttggctgtcagccatgagaagggcaagatcaccgttctgcagctctctgcactcctgaagcaagcagattccagcaaaaggaagttaactctgacccgcttggcttctgccccagttccttttactgtgttgagcctcacaggaaatccctgcaaggaagactacttggcggtttgtgggctaaaggactgtcatgtgctcacctttagtagctcaggctctgtttcggatcacttggttttgcaccctcagttggcaacggggaacttcatcatcaaagccgtgtggttacctggttcacagaccgagttagcaattgtcaccgcagactttgttaagatttatgacctgtgtgttgatgccttgagtccaaccttctattttctcctgccaagctcaaagataagagatgttaccttccttttcaatgaggagggaaagaacatcattgttataatgtcttcggctgggtacatctatactcagcttatggaagaggccagcagtgcccagcagggacccttctatgtcactaatgtgttggaaatcaatcatgaggacctgaaggacagtaacagccaggtggcgggcggtggtgtgtccgtgtactactcccacgtgttgcagatgttgttcttcagctattgtcaaggcaaatcattcgcagccaccatcagcaggacaaccctggaggtgttgcaactcttccccatcaacatcaaaagttccaatggtggcagtaagacttctcctgctctttgccagtggtctgaggtgatgaaccaccctggcttggtgtgctgtgtccagcaaactacaggggtgccgctggtagttatggtgaaaccagacacttttcttatccaggagattaagactcttcctgctaaagcgaagatccaagacatggttgctattaggcacacggcctgcaatgagcagcagcggacaacaatgattctgctgtgcgaggatggcagcctgcgcatttacatggccaacgtggagaacacctcctactggctgcagccatccctgcagcccagcagtgtcatcagcatcatgaagcctgttcgaaagcgcaaaacagctacaatcagtaaggctccttctcagatgacttcaacccgcacgtctagccaggtgactttccccattgacttttttgaacacaaccagcagctgacagatgtggagtttggtggtaacgacctcctacaggtctataatgcacaacagataaaacaccggctgaattccactggcatgtatgtggccaacaccaagcccggaggcttcaccattgagattagtaacaacaatagcactatggtgatgacaggcatgcggatccagattgggactcaagcaatagaacgggccccgtcatatatcgagatcttcggcagaactatgcagctcaacctgagtcgctcacgctggtttgacttccccttcaccagagaagaagccctgcaggctgataagaagctgaacctcttcagtgagtcaccaacccctggtgcagactctgtcctcattgtgactgcgaaattgggagccactggcctgtggctgtccaacattctgggatctctccactctgctgatttttctgtcctttcatcaggaaactttgagcttcatttgatgtattaaagaggcaaggtgacaggaaaggagtacaccggagcatggtagcagtaaagatagggctgcactgtgttgagtattcatttcaatagtgttgtgtccacctcactaatggggctacttctgtgtttaggccgagaggaggcagattgacatgaaattgcaaggctttcttaacgcacagaggaagacctcaggtcacacatggctgagagatggttggcaatggcttgctatgccactgaaaactaaactctcagaatacaaatccttgagccttactcaagactgcatttctctgtcatttattggccactgtctgatattctttcttctagatatagttgctgttagtgtgaatgatcatgatctgtactttgaacaaagaaagtgtgtagagacccctgggagtgaggggtaggggatacaatactctgaagcagaagaggacccttgcagtgatggttagggactcttctgagtaggagacgtaatcggcttttggtccatggaacttttaccacatgtattcagcatatatacacgattaaagtgctgcaaatatctcag

SEQ ID NO: 209 - DNA, 8037 bp, Homo sapiens
  CDS (1654)..(7329)
atgggcttcctgcaccagctgcagctgctgctctggaagaacgtgacgctcaaacgccggagcccgtgggtcctggccttcgagatcttcatccccctggtgctgttctttatcctgctggggctgcgacagaagaagcccaccatctccgtgaaggaagtccccttctacacagcggcgcccctgacgtctgccggcatcctgcctgtcatgcaatcgctgtgcccggacggccagcgagacgagttcggcttcctgcagtacgccaactccacggtcacgcagctgcttgagcgcctggaccgcgtggtggaggaaggcaacctgtttgacccagcgcggcccagcctgggctcagagctcgaggccctacgccagcatctggaggccctcagtgcgggcccgggcacctcggggagccacctggacagatccacagtgtcttccttctctctggactcggtggccagaaacccgcaggagctctggcgtttcctgacgcaaaacttgtcgctgcccaatagcacggcccaagcactcttggccgcccgtgtggacccgcccgaggtctaccacctgctctttggtccctcatctgccctggattcacagtctggcctccacaagggtcaggagccctggagccgcctagggggcaatcccctgttccggatggaggagctgctgctggctcctgccctcctggagcagctcacctgcacgccgggctcgggggagctgggccggatcctcactgtgcctgagagtcagaagggagccctgcagggctaccgggatgctgtctgcagtgggcaggctgctgcgcgtgccaggcgcttctctgggctgtctgctgagctccggaaccagctggacgtggccaaggtctcccagcagctgggcctggatgcccccaacggctcggactcctcgccacaggcgccacccccacggaggctgcaggcgcttctgggggacctgctggatgcccagaaggttctgcaggatgtggatgtcctgtcggccctggccctgctactgccccagggtgcctgcactggccggacccccggacccccagccagtggtgcgggtggggcggccaatggcactggggcaggggcagtcatgggccccaacgccaccgctgaggagggcgcaccctctgctgcagcactggccaccccggacacgctgcagggccagtgctcagccttcgtacagctctgggccggcctgcagcccatcttgtgtggcaacaaccgcaccattgaacccgaggcgctgcggcggggcaacatgagctccttgggcttcacgagcaagaagcagcggaacctgggcctcctcgtgcacctcatgaccagcaaccccaaaatcctgtacgcgcctgcgggctctgaggtcgaccgcgtcatcctcaaggccaacgagacttttgcttttgtgggcaacgtgactcactatgcccaggtctggctcaacatctcggcggagatccgcagcttcctggagcagggcaggctgcagcaacacctgcgctggctgcagcagtatgtagcagagctgcggctgcaccccgaggcactgaacctgtcactggatgagctgccgccggccctgagacaggacaacttctcgctgcccagtggcatggccctcctgcagcagctggataccattgacaacgcggcctgcggctggatccagttcatgtccaaggtgagcgtggacatcttcaagggcttccccgacgaggagagcattgtcaactacaccctcaaccaggcctaccaggacaacgtcactgtttttgccagtgtgatcttccagacccggaaggacggctcgctcccgcctcacgtgcactacaagatccgccagaactccagcttcaccgagaaaaccaacgagatccgccgcgcctactggcggcctgggcccaatactggcggccgcttctacttcctctacggcttcgtctggatccaggacatgatggagcgcgccatcatcgacacttttgtggggcacgacgtggtggagccaggcagctacgtgcagatgttcccctacccctgctacacacgcgatgacttcctgtttgtcattgagcacatgatgccgctgtgcatggtgatctcctgggtctactccgtggccatgaccatccagcacatcgtggcggagaaggagcaccggctcaaggaggtgatgaagaccatgggcctgaacaacgcggtgcactgggtggcctggttcatcaccggctttgtgcagctgtccatctccgtgacagcactcaccgccatcctgaagtacggccaggtgcttatgcacagccacgtggtcatcatctggctcttcctggcagtctacgcggtggccaccatcatgttctgcttcctggtgtctgtgctgtactccaaggccaagctggcctcggcctgcggtggcatcatctacttcctgagctacgtgccctacatgtacgtggcgatccgagaggaggtggcgcatgataagatcacggccttcgagaagtgcatcgcgtccctcatgtccacgacggcctttggtctgggctctaagtacttcgcgctgtatgaggtggccggcgtgggcatccagtggcacaccttcagccagtccccggtggagggggacgacttcaacttgctcctggctgtcaccatgctgatggtggacgccgtggtctatggcatcctcacgtggtacattgaggctgtgcacccaggcatgtacgggctgccccggccctggtacttcccactgcagaagtcctactggctgggcagtgggcggacagaagcctgggagtggagctggccgtgggcacgcaccccccgcctcagtgtcatggaggaggaccaggcctgtgccatggagagccggcgctttgaggagacccgtggcatggaggaggagcccacccacctgcctctggttgtctgcgtggacaaactcaccaaggtctacaaggacgacaagaagctggccctgaacaagctgagcctgaacctctacgagaaccaggtggtctccttcttgggccacaacggggcgggcaagaccaccaccatgtccatcctgaccggcctgttccctccaacgtcgggttccgccaccatctacgggcacgacatccgcacggagatggatgagatccgcaagaacctgggcatgtgcccgcagcacaatgtgctctttgaccggctcacggtggaggaacacctctggttctactcacggctcaagagcatggctcaggaggagatccgcagagagatggacaagatgatcgaggacctggagctctccaacaaacggcactcactggtgcagacattgtcgggtggcatgaagcgcaagctgtccgtggccatcgccttcgtgggcggctctcgcgccatcatcctggacgagcccacggcgggcgtggacccctacgcgcgccgcgccatctgggacctcatcctgaagtacaagccaggccgcaccatccttctgtccacccaccacatggatgaggctgacctgcttggggaccgcattgccatcatctcccatgggaagctcaagtgctgcggctccccgctcttcctcaagggcacctatggcgacgggtaccgcctcacgctggtcaagcggcccgccgagccggggggcccccaagagccagggctggcatccagccccccaggtcgggccccgctgagcagctgctccgagctccaggtgtcccagttcatccgcaagcatgtggcctcctgcctgctggtctcagacacaagcacggagctctcctacatcctgcccagcgaggccgccaagaagggggctttcgagcgcctcttccagcacctggagcgcagcctggatgcactgcacctcagcagcttcgggctgatggacacgaccctggaggaagtgttcctcaaggtgtcggaggaggatcagtcgctggagaacagtgaggccgatgtgaaggagtccaggaaggatgtgctccctggggcggagggcccggcgtctggggagggtcacgctggcaatctggcccggtgctcggagctgacccagtcgcaggcatcgctgcagtcggcgtcatctgtgggctctgcccgtggcgacgagggagctggctacaccgacgtctatggcgactaccgccccctctttgataacccacaggacccagacaatgtcagcctgcaagaggtggaggcagaggccctgtcgagggtcggccagggcagccgcaagctggacggcgggtggctgaaggtgcgccagttccacgggctgctggtcaaacgcttccactgcgcccgccgcaactccaaggcactcttctcccagatcttgctgccagccttcttcgtctgcgtggccatgaccgtggccctgtccgtcccggagattggtgatctgcccccgctggtcctgtcaccttcccagtaccacaactacacccagccccgtggcaatttcatcccctacgccaacgaggagcgccgcgagtaccggctgcggctatcgcccgacgccagcccccagcagctcgtgagcacgttccggctgccgtcgggggtgggtgccacctgcgtgctcaagtctcccgccaacggctcgctggggcccacgttgaacctgagcagcggggagtcgcgcctgctggcggctcggttcttcgacagcatgtgtctggagtccttcacacaggggctgccactgtccaatttcgtgccacccccaccctcgcccgccccatctgactcgccagcgtccccggatgaggacctgcaggcctggaacgtctccctgccgcccaccgctgggccagaaatgtggacgtcggcaccctccctgccgcgcctggtacgggagcccgtccgctgcacctgctctgcgcagggcaccggcttctcctgccccagcagtgtgggcgggcacccgccccagatgcgggtggtcacaggcgacatcctgaccgacatcaccggccacaatgtctctgagtacctgctcttcacctccgaccgcttccgactgcaccggtatggggccatcacctttggaaacgtcctgaagtccatcccagcctcatttggcaccagggccccacccatggtgcggaagatcgcggtgcgcagggctgcccaggttttctacaacaacaagggctatcacagcatgcccacctacctcaacagcctcaacaacgccatcctgcgtgccaacctgcccaagagcaagggcaacccggcggcttacggcatcaccgtcaccaaccaccccatgaataagaccagcgccagcctctccctggattacctgctgcagggcacggatgtcgtcatcgccatcttcatcatcgtggccatgtccttcgtgccggccagcttcgttgtcttcctcgtggccgagaagtccaccaaggccaagcatctgcagtttgtcagcggctgcaaccccatcatctactggctggcgaactacgtgtgggacatgccgcccccacccctgcagctcaactacctggtccccgctacctgctgtgtcatcatcctgtttgtgttcgacctgccggcctacacgtcgcccaccaacttccctgccgtcctctccctcttcctgctctatgggtggtccatcacgcccatcatgtacccggcctccttctggttcgaggtccccagctccgcctacgtgttcctcattgtcatcaatctcttcatcggcatcaccgccaccgtggccaccttcctgctacagctcttcgagcacgacaaggacctgaaggttgtcaacagttacctgaaaagctgcttcctcattttccccaactacaacctgggccacgggctcatggagatggcctacaacgagtacatcaacgagtactacgccaagattggccagtttgacaagatgaagtccccgttcgagtgggacattgtcacccgcggactggtggccatggcggttgagggcgtcgtgggtttcctcctgaccatcatgtgccagtacaacttcctgcggcggccacagcgcatgcctgtgtctaccaagcctgtggaggatgatgtggacgtggccagtgagcggcagcgagtgctccggggagacgccgacaatgacatggtcaagattgagaacctgaccaaggtctacaagtcccggaagattggccgtatcctggccgttgaccgcctgtgcctgggtgtgcgtcctggcgagtgcttcgggctcctgggcgtcaacggtgcgggcaagaccagcaccttcaagatgctgaccggcgacgagagcacgacggggggcgaggccttcgtcaatggacacagcgtgctgaaggagctgctccaggtgcagcagagcctcggctactgcccgcagtgtgacgcgctgttcgacgagctcacggcccgggagcacctgcagctgtacacgcggctgcgtgggatctcctggaaggacgaggcccgggtggtgaagtgggctctggagaagctggagctgaccaagtacgcagacaagccggctggcacctacagcggcggcaacaagcggaagctctccacggccatcgccctcattgggtacccagccttcatcttcctggacgagcccaccacaggcatggaccccaaggcccggcgcttcctctggaacctcatcctcgacctcatcaagacagggcgttcagtggtgctgacatcacacagcatggaggagtgcgaggcgctgtgcacgcggctggccatcatggtgaacggtcgcctgcggtgcctgggcagcatccagcacctgaagaaccggtttggagatggctacatgatcacggtgcggaccaagagcagccagagtgtgaaggacgtggtgcggttcttcaaccgcaacttcccggaagccatgctcaaggagcggcaccacacaaaggtgcagtaccagctcaagtcggagcacatctcgctggcccaggtgttcagcaagatggagcaggtgtctggcgtgctgggcatcgaggactactcggtcagccagaccacactggacaatgtgttcgtgaactttgccaagaagcagagtgacaacctggagcagcaggagacggagccgccatccgcactgcagtcccctctcggctgcttgctcagcctgctccggccccggtctgcccccacggagctccgggcacttgtggcagacgagcccgaggacctggacacggaggacgagggcctcatcagcttcgaggaggagcgggcccagctgtccttcaacacggacacgctctgctgaccacccagagctgggccagggaggacacgctccactgaccacccagagctgggccagggactcaacaatggggacagaagtcccccagtgcctgccagggcctggagtggaggttcaggaccaaggggcttctggtcctccagcccctgtactcggccatgccctgcggtcactgcggttgccgcccctaattgtgccaaaggctgacccggcccgggctgcgtacacccttgccctgctttgccttaaagcctcggggtctgcccggcccctcgcccctgcctggcactgctcaccgcccaaggcgacgccggctggaccaggcactgctggcctttctcctgcccggcctcggaaccagcttttctctcttacgatgaaggctgatgccgagagcgggctgtgggcggagctgggtcagtcccgtatttattttgctttgagaagaggctcctctggccctgctctcctgcagggaggtggctgtcccgcgggaagccatcagcttgggccagctggcaggtggcaggaatggagaagctgaccctgctggccaggcaaggggccagaccccccccaacccccagctgccatcgctctcccacccagcttggccccctgcccgcccacctccctgggagccgggcctgtacatagcgcacagatgtttgttttaaataaataaacaaaatgtcaaaaaaaaaaaaa

SEQ ID NO: 210 - DNA, 1595 bp, Homo sapiens
  CDS (152)..(1537)
gctgacgacgatttcgtggcggcgacggtggaaggagcctggctctggtggcccccagaagctctctgggcctggtggtcgggagagggactacattgcaccatgggaaagagagagaagggatgccagcgaagagacaagcacttccgtcatgcagaaaacccccatcatcctctcaaaacctccagcagagcggtcaaaacagccaccacctccaacagcccctgctgccccgcctgctccagcccctctggagaagcccatcgttctcatgaagccacgggaggaggggaaggggcctgtggccgtgacaggtgcctctacccctgagggcaccgccccaccaccccctgcagcccctgcgccacccaagggggagaaggaggggcagagacccacacagcctgtgtaccagatccagaaccggggcatgggcactgccgcaccagcagccatggaccctgtcgtgggtcaggccaaactactgcccccagagcgcatgaagcacagcatcaagttggtggatgaccagatgaattggtgtgacagtgccatcgagtacctgttggatcagactgatgtgttggtggttggtgtcctgggcctccaggggacaggcaagtccatggtcatgtcattgttgtcagccaacactccagaggaggaccagaggacttatgttttccgggcccagagcgctgaaatgaaggaacgagggggcaaccagaccagtggcatcgacttctttattacccaagaacggattgttttcctggacacacagcccatcctgagcccttctatcctagaccatctcatcaataatgaccgcaaactgcctccagagtacaaccttccccacacttacgttgaaatgcagtcactccagattgctgccttccttttcacggtctgccatgtggtgattgttgtccaggactggttcacagacctcagtctctacaggttcctgcagacagcagagatggtgaagccctccaccccatcccccagccatgagtccagcagctcatcgggctccgatgaaggcaccgagtactacccccacctagtcttcttgcagaacaaagctcgccgagaggacttctgtcctcggaagctgcagcagatgcacctgatgattgaccagctcatggcccactcccacctgcgttacaagggaactctgtccatgttacaatgcaatgtcttcccggggcttccacctgacttcctggactctgaggtcaacttattcctggtacccttcatggacagtgaagcagagagtgaaaacccaccaagagcaggacctggttccagcccactcttctccctgctgcctgggtatcggggccaccccagtttccagtccttggtgagcaagctccggagccaagtgatgtccatggcccggccacagctgtcacacacgatcctcaccgagaagaactgcagaggactcaggctgatgctgccagcaggccactggggacaccagctagatatactgctgcagggaggccttctgctctaggatgggctgcaagatgggcctggccaccaggaatgcctgctgcttgtggctctccaag

SEQ ID NO: 211 - DNA, 2335 bp, Homo sapiens
  CDS (90)..(1253)
gcggcggcccggccagcccggcccggcccggggccgcgtcctgagagtcagccctcgccgctgcagcctcggcgcccggccggccggccatggagcgccccccgccccgcgccgccggccgggaccccagtgcgctgcgggccgaggcgccgtggctgcgcgcggagggtccggggccgcgcgccgcgcccgtgacggtgcccacgccgccgcagggctcttccgtgggcggcggcttcgcgggcttggagttcgcgcggccgcaggagtcggagccgcgggcctcggacctgggggccccccggacgtggacgggggcggcggcggggccccggactccgtcggcgcacatccccgtcccagcgcagagagccaccccaggaaaagcccggctggacgaggtcatggctgccgctgcccttacaagcctgtccaccagccctctccttctgggggccccagttgcagccttcagcccagagcctggcctggagccctggaaggaggccctggtgcggcccccaggcagctacagcagcagcagcaacagtggagactggggatgggacctggccagtgaccagtcctctccgtccaccccgtcacccccactgccccccgaggcagcccactttctgtttggggagcccaccctgagaaaaaggaagagcccggcccaggtcatgttccagtgtctgtggaagagctgcgggaaggtgctgagcacggcgtcggcgatgcagagacacatccgcctggtgcacctggggaggcaggcagagcctgatcagagtgatggtgaggaggacttctactacacagagctggatgttggtgtggacacgctgaccgacgggctgtccagcctgactccagtgtcccccacggcctccatgccgcctgccttcccccgcctggagctgccagagctgctggagcccccagccctgcctagtcccctgcggccgcctgccccgcccctgcccccgccccctgtcctgagcaccgttgctaacccccagtcctgtcacagtgaccgtgtctaccagggctgcctgacgcccgcccgcctggagccgcagcccacggaggtcggagcctgcccacccgccttgtcctccaggatcggagtcaccctgaggaagccccgcggcgacgcgaagaagtgccggaaggtgtatggcatggagcgccgggacctctggtgcacagcctgccgctggaagaaagcctgccagcggttcctggactaagtccggctcgttcaagaacataagctaccaccttctccctccccaccccctccaggcccggggctgaaacagcccgaggacagccccaggggctggctttcaccagctgcagggtctgcttttacttggggtgggggggcggggctgaccctgaaccctcccccccgccaggtcggggaggggtcccaccactcaaagtgcctctaaagaaaccagctttttgcactaaagccaaaccacaccgctgtccccttagccccaagggccctgggggcagccaccctcccgcctgtcggcccgtagatttatcaagggtgttatgggcccagctttggggggccagtcccgatgcactttgaggggtgttggagaggggactcccccactcgcacttaactcaacggctctcgggccctggggctgtttttaccatgtttgtttttgaagctcaggtgtctcacgtctgggctgcaccaggcgaagagagaaattaaagatttgaggtttttcccagaagctttgtcgtgcctctcggggaggataggccctggggctggggccccgtcggtgggccagctgggtggaggtctggcacgctgccccccacagagggggccgacgggtcaacccgcttcggctcgctcgccacgctccccggcgatggccgcgagggagaggagtcactctgatgacgccacggagggcaatcctttctgggagcacgccagtgttccccacatttatttgtgaacgtgattcgccttttgcacaaggatgttctatagctatatctccgctcaccacgagaaaggtaatacgcacacacggcgccctacggcacgaaacattggaggaactcacccgccacgagggcccaccgtggtatcccaccggccacacacgaagagggcacggagcggcacgagccctgagtttccccccgacgcgagttacgagagaccttttcccccgcatagtagacacatttcccataccaaccccgggttataataagtaatagggagtccatataatatagattatcccccaggaaaaaatccaccatcttccaaaaaaaaaaa

SEQ ID NO: 212 - DNA, 3366 bp, Homo sapiens
  CDS (16)..(2568)
gaaaagagaaatatcatgtttatgcaagagcttcagtatttgtttgctctaatgatgggatcaaatagaaaatttgtagacccgtctgcagccctggatctattaaagggagcattccgatcatctgaggaacagcagatcatacctggctctttgggggttgatgaaaatgcactatttttgcttttgaatgatgcttggattttatgtagcacatatcttaatccaaacaatccagaattgtctccttttcctaaaagcagcagtcccaggaacaaatctgaaaatccaatggtgcagctgttctatggtactttcctgactgaaggggttcgtgaaggaaaacccttttgtaacaatgagaccttcggccagtatcctcttcaggtaaacggttatcgcaacttagacgagtgtttggaaggggccatggtggagggtgatgttgagcttcttccctccgatcactcggtgaagtatggacaagagcgttggtttacaaagctacctccagtgttgacctttgaactctcaagatttgagtttaatcagtcccttgggcagccagagaaaattcacaataagctggaatttcctcagattatttatatggacaggtacatgtacaggagcaaggagcttattcgaaataagagagagtgtattcgaaagttgaaggaggaaataaaaattctgcagcaaaaattggaaaggtatgtgaaatatggctcaggcccagctcggttcccgctcccggacatgctgaaatatgttattgaatttgctagtacaaaacctgcctcagaaagctgtccacctgaaagtgacacacatatgacattaccactttcttcagtgcactgctcggtttctgaccagacatccaaggaaagtacaagtacagaaagctcttctcaggatgttgaaagtaccttttcttctcctgaagattctttacccaagtctaaaccactgacatcttctcggtcttccatggaaatgccttcacagccagctccacgaacagtcacagatgaggagataaattttgttaagacctgtcttcagagatggaggagtgagattgaacaagatatacaagatttaaagacttgtattgcaagtactactcagactattgaacagatgtactgcgatcctctccttcgtcaggtgccttatcgcttgcatgcagttcttgttcatgaaggacaagcaaatgctggacactattgggcctatatctataatcaaccccgacagagctggctcaagtacaatgacatctctgttactgaatcttcctgggaagaagttgaaagagattcctatggaggcctgagaaatgttagtgcttactgtctgatgtacattaatgacaaactaccctacttcaatgcagaggcagccccaactgaatcagatcaaatgtcagaagtggaagccctatctgtggaactcaagcattacattcaggaggataactggcggtttgagcaggaagtagaggagtgggaagaagagcagtcttgcaaaatccctcaaatggagtcctccaccaactcctcatcacaggactactctacatcacaagagccttcagtagcctcttctcatggggttcgctgcttgtcatctgagcatgctgtgattgtaaaggagcaaactgcccaggctattgcaaacacagcccgtgcctatgagaagagcggtgtagaagcggcactgagtgaggcattccatgaagaatactccaggctctatcagcttgccaaagagacccccacctctcacagtgatcctcgacttcagcatgtccttgtctactttttccaaaatgaagcacccaaaagggtagtagaacgaacccttctggaacagtttgcagataaaaatcttagctatgatgaaagatcaatcagcattatgaaggtggctcaagcgaaactgaaggaaattggtccagatgacatgaatatggaagagtacaagaagtggcatgaagattatagtttgttccgaaaagtgtctgtgtatctcctaacaggcctagaactctatcaaaaaggaaagtaccaagaggcactttcctacctggtatatgcctaccagagcaatgctgccctgctgatgaaggggccccgccggggggtcaaagaatccgtgattgctttataccgaagaaaatgccttctggagctgaatgccaaagcagcttctctttttgaaacaaatgatgatcactccgtaactgagggcattaatgtgatgaatgaactgatcatcccctgcattcaccttatcattaataatgacatttccaaggatgatctggatgccattgaggtcatgagaaaccattggtgctcttaccttgggcaagatattgcagaaaatctgcagctgtgcctaggggagtttctacccagacttctagatccttctgcagaaatcatcgtcttgaaagagcctccaactattcgacccaattctccctatgacctatgtagccgatttgcagctgtcatggagtcaattcagggagtttcaactgtgacagtgaaataagctcccacatgttcaaggcccattctggttcctggctgcctgcctcttgcacagaagttcgttgtcatagtgctcaccttgggaaaaggattaggtgggcacataagattccgatcagaccccaaccatgctgcatgtgtaaagaaggattgaaaataaaattgcactttttaggtacaaaatcataaaagctgtttcactagaaaaggcagaaagcagtgtattaaggtgttgaattacgccagaagacctgaaatgccttgtacctacaacaatgcttaggcttttctaagcctcttgccacttttaaaattatccttcaggcataaatatttttgacagcagaatagaagaatgattcatgagaacctgaaccagatgaacagctactagttattttatcaaatacagatgacatttaaaaattcttaactacaagagattagaaatataaaccttgcctggctcttgccaggagataacaaaatgggttgctgatgaactgcacccttttacatgtgggtagaatataagctcacatggcagtgagatgttgaaaagtcaaaagagacctgtctctctcctttcttttctatctttaaaccagaaaacctcatactcagtcctcagtgaaagaaagtaaagtattaaggactttagacagaagagcattgtgtaacttgactgaagatcatccattaatagttattaggcatttaggtaaaattttctaatacctaaaaattgtcaaaaacagtcaatagggctactgctggcccaaagaccatttaggtccac

SEQ ID NO: 213 - DNA, 1280 bp, Homo sapiens
  CDS (12)..(1061)
gagccaagaccatggcgaaagccggggataagagcagcagcagcgggaagaaaagtctaaaacggaaagccgctgccgaagaacttcaggaggctgcaggcgctggggatggggcgacggaaaacggggtccaacccccgaaagcggctgcctttccgccaggctttagcatttcggagattaaaaacaaacagcggcgacacttaatgttcacgcggtggaaacagcagcagcggaaggaaaagttggcagctaagaaaaaacttaaaaaagaaagagaggctcttggcgataaggctccaccaaagcctgtacccaagaccattgacaaccagcgagtgtatgatgaaaccacagtagaccctaatgatgaagaggtcgcttatgatgaagctacagatgaatttgcttcttacttcaacaaacagacttctcccaagattctcatcacaacatcagatagacctcatgggagaacagtacgactctgtgaacagctctccacagttataccaaactcacatgtttattacagaagaggactggctctgaaaaaaattattccacagtgcatcgcaagagatttcacagacctgattgttattaatgaagatcgtaaaaccccaaatggacttattttgagtcacttgccaaatggcccaactgctcattttaaaatgagcagtgttcgtcttcgtaaagaaattaagagaagaggcaaggaccccacagaacacatacctgaaataattctgaataattttacaacacggctgggtcattcaattggacgtatgtttgcatctctctttcctcataatcctcaatttatcggaaggcaggttgccacattccacaatcaacgggattacatattcttcagatttcacagatacatattcaggagtgaaaagaaagtgggaattcaggaacttggaccacgttttaccttaaaattaaggtctcttcagaaaggaacctttgattctaaatatggagagtatgaatgggtccataagccccgggaaatggatacaagtagaagaaaattccatttataaagtactgagagaatgatattggattttgctgaacaggcctatcttgaactttggtaaattatttttgacagaatactcttttcaaaatggcatttgctgatttcataaacctttcacgtctggacgaattaccaaatgccatgaattgccactgtgtgtttatgtagaaaatacaaataaaagttattttgatggcttaggtttccttaaaaaaaaaaa

SEQ ID NO: 214 - DNA, 1839 bp, Homo sapiens
  CDS (111)..(1385)
gaattcgcgcgagcgctgcgccagatctcggtctgatggacgcctggtgtggacgatgagggaagaacgtgccccccacacccaagaggtgacccctgagccagccccggatgaccctgcgacctggaacaatgcggctggcctgcatgttctcttccatcctgctgttcggagctgcaggcctcctcctcttcatcagcctgcaggaccctacggagctcgccccccagcaggtgccaggaataaagttcaacatcaggccaaggcagccccaccacgacctcccaccaggcggctcccaggatggtgacttgaaggaacccacagagagggtcactcgggacttatccagtggggccccgaggggccgcaacctgccagcgcctgaccagcctcaacccccgctgcagaggggaacccgtctgcggctccgccagcgccgtcgccgtctgctcatcaagaaaatgccagctgcggcgaccatcccggccaacagctcggacgcgcccttcatccggccgggacccgggacgctggatggccgctgggtcagcctgcaccggagccagcaggagcgcaagcgggtgatgcaggaggcctgcgccaagtaccgggcgagcagcagccgccgggccgtcacgccccgccacgtgtcccgtatcttcgtggaggaccgccaccgcgtgctctactgcgaggtgcccaaggccggctgctccaattggaagcgggtgctcatggtgctggccggcctggcctcgtccactgccgacatccagcacaacaccgtccactatggcagcgctctcaagcgcctggacaccttcgaccgccagggtatcttgcaccgtctcagcacctacaccaagatgctctttgtccgcgagcccttcgagaggctggtgtccgccttccgcgacaagtttgagcaccccaacagctactatcacccggtcttcggcaaggccatcctggcccggtaccgcgccaatgcctctcgggaggccctgcggaccggctctggggtgcgttttcccgagttcgtccagtacctgctggacgtgcaccggcccgtggggatggacattcactgggaccatgtcagccggctctgcagcccctgcctcatcgactacgatttcgtaggcaagttcgagagcatggaggacgatgccaacttcttcctgagcctcatccgcgcgccgcggaacctgaccttcccccggttcaaggaccggcactcgcaggaggcgcggaccacagcgaggatcgcccaccagtacttcgcccaactctcggccctgcaaaggcagcgcacctacgacttctactacatggattacctgatgttcaactattccaagccctttgcagatctgtactgaggggcgccgcagctggccggggccgccctgccccggtcactcacctgtgctcccgggcatcctcctgtccctggctcctcatcctgggagcaacagggctctgaggacgtgaggagccatcgctgtgggaggcagcaggccccgggtggggggcagaggcgcccagccttggatggggaccccagcccctggcctgtacctgtttcctcattccttggctgagggagaggctgagaactgggcagacacccctggagctcagccgacagttttgatgagcagggaagtctgaggcccagaggacggggggcccagcggtaagggatgtcccgcactcccttagccattgccttggaccaaaccacgtggtttgcagcttttctacgagccaggggggaggttcccttggattaaggttccaaataaagcacatggtttccagaaaaaaaaaaaa

SEQ ID NO: 215 - DNA, 955 bp, Homo sapiens
  CDS (79)..(810)
tttcgtccggcctccctccctccctcgcccgcccggcgctcgcagagccgacaccaggggggctctcgatgtagcaccatgacaggcatcgccgccgcctccttcttctccaatacctgccgattcgggggctgcggactccacttccccaccctggccgacctcatcgagcacatcgaggacaaccacatcgatacagatccacgggttttagaaaaacaagaattacagcagccaacctatgttgccctgagttacataaatagattcatgacagatgctgcccgccgagagcaggagtccctaaagaagaagattcagccgaagctctcgctgactctgtccagctcagtgtctcgagggaatgtgtccactcccccacgccacagcagtggaagccttactccccccgtgaccccacccatcaccccctcctcttcattccgcagcagcactccgacaggcagcgagtatgacgaggaggaggtggactatgaggagtcggacagcgatgagtcctggaccacagagagtgccatcagctccgaagccatcctcagctccatgtgcatgaatggaggggaagagaagccttttgcctgcccagttcctggatgtaaaaagagatacaagaatgtgaatggcataaagtatcacgctaagaatggtcacagaacacagattcgtgtccgcaaaccattcaagtgtcgctgtgggaagagttacaagacagctcagggcctgcggcaccacacaatcaatttccatcccccggtgtcggctgagattatcaggaagatgcagcaataacatgctggtcataactgtgccaagaaatcctcaccagcagttgctgattttgaaaacagccaccttttttcaggggaagcattcagcaaccctttaaagaaaaagaattaaatgcatgctttaaattttttctgtaaaaaaaaaa

SEQ ID NO: 216 - DNA, 1194 bp, Homo sapiens
  CDS (1)..(648)
atggcggattcctcgcccgcactgtccctgcgggaaggcggcccccgcgcgccgcggccctcggccccctcgccgccgccgcgctcgcgctccggctccgagtccgaggaggccgagctgtcgctgagcctggcccgcaccaagacccgctcgtacggcagcaccgccagcgtgcgggcgccgctgggcgccggcgtcatcgagcgccatgtggagcaccgggtccgcgcgggcgacacgctgcagggcatcgcgctcaagtacggtgtcacgatggaacagattaaaagggccaataaactgtttaccaatgattgtatatttctgaagaaaactttgaacatcccagttatatcagagaagcctttgttgtttaatggacttaactccattgattctccagaaaatgaaactgctgataacagtttttctcaggaagaggagccagtggtggccggggaagacctccctcctcccagtcctcaagaatctgatgttcagcctgtgcagcctgaggaagtgtcagccagagatttcctgcagagacttgacttgcagattaagttatcaacacaggcagccaagaagctaaaagaagagagcagagatgaagaaagtccctatgcaacttccctctatcacagttaggtgatttgggggcataactctaaccaaaattaagatatgtttggaccataaagaatccaacaactgaagattcaaaaacatcccttctggattcctatagtgtccatcttaaaatcataactaggtagttctacctgctgcagttgcactgaagtgattagttccctctggctttctataattttaagtctttattatggcatgatggcaaggttgtagcctaaagctcatcacttttgtaggtggtgttagtttttagactagcttttataaatactaattgacataaagcatcaaagattatttatatatttaggctaaaaataatgtttatctccttatgcaatcctgattatgtgaaaatatggttgctgtttaagtgatgctgaatttgctgtgtgtttataacttaagtgctatatatatatttcgatatgtcttacatattctctattaatataaagaaccaaattttgtctgctattttgtaaaaataaactacaaaagcctgaatgagaaaataaactatgttttcaaaaaaaaaaa

SEQ ID NO: 217 - DNA, 5787 bp, Homo sapiens
  CDS (54)..(4424)
tgtggacccccgagtggctgcggtgctcaccgggcaatatcccctatgctgatatgaaatatacagataagagaaatttaagagaaactgaaacttcccttgttagaaaagagcccttaacaacaattcttgcgctttctgttcaggggctctttgacaattataaaggctctggcggcagcgtgcatcacaagtgtaacagcgccaaacaccgcatcatctcgcccaaggtggagccacggacaggggggtacgggagccactcggaggtgcagcacaatgacgtgtcggagggcaagcacgagcacagccacagcaagggctccagccgtgagaagaggaacggcaaggtggccaagcccgtgctcctgcaccagagcagcaccgaggtctcctccaccaaccaggtggaagtccccgacaccacccagagctcccctgtgtccatcagcagcgggctcaacagcgacccggacatggtggacagcccggtggtcacaggtgtgtccggtatggcggtggcctctgtgatggggagcttgtcccagagcgccacggtgttcatgtcagaggtcaccaatgaggccgtgtacaccatgtcccccaccgctggccccaaccaccacctcctctcacctgacgcctctcagggcctcgtcctggccgtgagctctgatggccacaagttcgcctttcccaccacgggcagctcagagagcctgtccatgctgcccaccaacgtgtccgaagagctggtcctctccaccaccctcgacggtggccggaagattccagaaaccaccatgaactttgaccccgactgtttccttaataacccaaagcagggccagacgtacgggggtggaggcctgaaagccgagatggtcagctccaacatccggcactcgccacccggggagcggagcttcagctttaccaccgtcctcaccaaggagatcaagaccgaggacacctccttcgagcagcagatggccaaagaagcgtactcctcctccgcggcggctgtggcagccagctccctcaccctgaccgccggctccagcctcctgccgtcgggcggcggcctgagtcccagcaccaccctggagcagatggacttcagcgccatcgactccaacaaggactacacgtccagcttcagccagacgggccacagcccccacatccaccagaccccctccccgagcttcttcctgcaggacgccagcaaacccctccccgtcgagcagaacacccacagcagcctgagtgactctgggggcaccttcgtgatgcccacggtgaaaacggaggcctcgtcccaaaccagctcctgcagcggtcacgtggagacgcggatcgagtccacttcctccctccacctcatgcagttccaggccaacttccaggccatgacggcagaaggggaggtcaccatggagacctcgcaggcggcggaagggagcgaggtcctgctcaagtctggggagctgcaggcttgcagctctgagcactacctgcagccggagaccaacggggtaatccgaagcgccggcggcgtccccatcctcccgggcaacgtggtgcagggactctaccccgtggcccagcccagcctcggcaacgcctccaacatggagctcagcctggaccactttgacatctccttcagcaaccagttctccgacctgatcaacgacttcatctccgtggaggggggcagcagcaccatctatgggcaccagctggtgtcgggggacagcacggcgctctcacagtcagaggacggggcgcgggcccccttcacccaggcagagatgtgcctcccctgctgtagcccccagcagggtagcctgcagctgagcagctcggagggcggggccagcaccatggcctacatgcacgtcgccgaggtggtctcggccgcctcggcccagggcaccctaggcatgctgcagcagagcggacgggtgttcatggtgaccgactactccccagagtggtcttacccagagggaggagtgaaggtcctcatcacaggcccgtggcaagaagccagcaataactacagctgcctgtttgaccagatctcagtgcctgcatccctgattcagcctggggtgctgcgctgctactgcccagcccatgacactggtcttgtgaccctacaagttgccttcaacaaccagatcatctccaactcggtggtgtttgagtacaaagcccgggctctgcccacgctcccttcctcccagcacgactggctgtcgttggacgataaccagttcaggatgtccatcctggaacgactggagcagatggagaggaggatggccgagatgacggggtcccagcagcacaaacaggcgagcggaggcggcagcagtggaggcggcagcgggagcgggaatggagggagccaggcacagtgtgcttctgggactggggccttggggagctgctttgagagccgtgtggtcgtggtatgcgagaagatgatgagccgagcctgctgggcgaagtccaagcacttgatccactcaaagactttccgcggaatgaccctactccacctggccgctgcccagggctatgccaccctaatccagaccctcatcaaatggcgtacaaagcacgcggatagcattgacctggaactggaagttgaccccttgaatgtggaccacttctcctgtactcctctgatgtgggcgtgtgccctagggcacttggaagctgccgtcgtgctgtacaagtgggaccgtcgggccatctcgattcccgactctctaggaaggctgcctttgggaattgccaggtcacggggtcatgtgaaattagcagagtgtctggagcacctgcagagagatgagcaggctcagctgggacagaaccccagaatccactgtcctgcaagcgaagagcccagcacagagagctggatggcccagtggcacagcgaagccatcagctctccagaaatacccaagggagtcactgttattgcaagcaccaacccagagctgagaagacctcgttctgaaccctctaattactacagcagtgagagccacaaagattatccggctcccaaaaagcataaattgaaccctgagtacttccagacaaggcaggagaagctgcttcccactgcactgagtctggaagagccaaatatcaggaagcaaagccctagttctaagcagtctgtccccgagacactcagccccagtgaaggagtgagggacttcagccgggaactctcccctcccactccagagactgcagcatttcaagcctctggatctcagcctgtaggaaagtggaattccaaagatctttacattggtgtgtctacagtacaggtgactggaaatccgaaggggaccagtgtaggaaaggaggcagcaccttcacaggtgcgtccacgggaaccaatgagtgtcctgatgatggctaacagagaggtggtgaatacagagctggggtcctaccgtgatagtgcagaaaatgaagaatgcggccagcccatggatgacatacaggtaaaaagcagggacagggtgaacatgatgaccttggcagaacacattattgaagccacacctgaccgaatcaagcaggagaattttgtgcccatggagtcctcaggattggaaagaacagaccctgccaccattagcagtacaatgagctggctggccagttatctagcggatgctgactgccttcccagtgctgcccagatccgaagtgcatataacgagcctctaaccccttcttctaataccagcttgagccctgttggctctcccgtcagtgaaatcgctttcgagaaacctaaccttccctccgccgcggattggtcagaattcctgagtgcatctaccagtgagaaggtagagaatgagtttgctcagctcactctgtctgatcatgaacagagagaactctatgaggctgccaggcttgtccagacagctttccggaaatacaagggccgacccttgcgggaacagcaagaagtagctgctgctgttattcagcgttgttacagaaaatataaacagctgacatggatagccttgaagtacgcactttataaaaagatgacacaggctgccatccttatccagagcaaattccgaagttactatgaacaaaaaaaattccagcagagccgacgggctgctgtgctcatccaaaagtactaccgaagttataagaaatgtggcaaaagacggcaggctcgccggacggctgtgattgtacaacagaaactcaggagcagtttgctaaccaaaaagcaggatcaagctgctcgaaaaataatgaggtttcttcgccgctgtcgccacagccccctggtggaccataggctgtacaaaaggagtgaaagaattgaaaaaggccaaggaacttgaagacatacagcagcatcccttagcaatgtgacattgcttttcagactgttttcatttctgtttttagcagagacatgcaacaacaacacacacgcacacacgcacacacacacacgtacacacacatacaaaatccctctgcagttttggggagatcagctgcaggattttaacaggaatgttttggtcattgcatttgcactttcatggacaacttttaatttgatcagcaagacatcttggaactcaatcttctgttggatcacgggaaatcaagacacccaggaggaattgaaagaggcttcctcttctcaggaagaagccatttccttctcatatagggctgtattcaaacatcgtgtggaactgtacaaatatttataccaaaaatatagataagaaaaggtggggctatactagcaacaaaaaaagaatgctgttcctgcacctgccggttatttccaagaagctgaatctttgggactgattctcagtggagggcttagatcatacaaaaatctttattgggtccgtgtgttctcatttccttcactgtttatttttgtttgtttgtttgtttgttttaatctctacagcacatttaatgcaacttttgaaatctgcaggtttttaatgtcttgtggaaatttgcagaggggcaggtgtgtggtaaacgggtaatgcatgggaaataatgagaagcagctcacagagtttaaactattttcttgtccccaccaccttccaagaacctgcgagggtagtaatcatcttgtcccctttttcatgttcagcactttaatttttttgccttactttcatgtgcaatgagaattacttaagaattggtaacgcatgtagccttttttagtaaccttggaagctgtagaaattctaaggaatcatgaaccttgcctggacatttgccacctaaacgatcagtgtggtgctgcgttctggccagtaaattccatgtttttggctatatctcatccaaactgagcagtttctgtgtatatatagaaggtagaaatgaaaagtgagaaaatatttgaaagggattatattaattgctaaatattttattcacaaaggtcaataacatggcaagataaaattatttgtatagttttgtctgaatgagcgagaaaaatgtggatgtactgtttgtatatattgtatatattaaaacagagatatgtgcatgaaatcaagaaaaaagaaatgaacaaaagcaaagcattagtggctatggtctgtaaaatgaaacaaaaaaactttatttcactataagagtactttattttaaatgttctttaggagaacattttgctaaagcatgactaaactgcaaaaaaaaaaa

SEQ ID NO: 218 - DNA, 3583 bp, Homo sapiens
  CDS (1)..(3009)
atgaggaaatactctagaggctggtggagccacaaggaatctgggcccctggatggtggagaagcgccatcacctgtctctgactatcctcctatgggtggaccattagccaacagtgttcacacctgtctcatttacctgctgtattctggggttcctctgttacagcagcttagcctatacccgactaaatacagtgatttagcagaggaaaggaaaagtggtgtgggaacaaatattccatccctgtggaatccgtcagattcatctgaggaagtggtttttagccaagtcttgaaagtatatagattgagcgactttacgatggcaacaagtatggcggctgctagtggtagatttgaaagtgcgaagagtatcgaagagcggaaagaacagacccggaatgccagggccgaggtgttgcgccaggctaaagccaattttgaaaaagaagaaaggcgtaaagaacttaagcgacttcggggtgaggatacatggatgctacctgatgtgaatgagagaattgaacagttctcacaggaacactctgtgaagaaaaagaagaaaaaagacaagcattcaaaaaaagcaaagaaagaaaagaaaaaaaagagcaagaaacagaaatatgaaaaaaacaatgagtcatctgatagctcatcaagctctgaagatgagtgggttgaggctgttccatcccagactcctgacaaggaaaaagcctggaaagtgaaagatgaaaagtcaggaaaagatgacacccaaattatcaagagggatgagtggatgactgttgattttatgtctgttaaaactgtgtcatcatcatcactcaaagctgaaaaggaaactatgaggaaaatagagcaagagaaaaaccaagcgcttgaacagtccaaactgatggaaagagaattgaatccgtactggaaggatggtgggacaggtcttccacctgaagactgtagtgtgtcatcgattactaaagtttcagtggtagaagatggtggattaagctggctaaggaaatcttatctaagaatgaaggaacaagctgagaaacaaagtagaaactttgaggacattgtagccgaaagatatgggtcaatggaaatatttcagtcaaaattagaagatgctgaaaaagctgcatccacgaaagaagattatagacgggaacggtggaggaaacccacatattcagataaagcacaaaattgtcaagaaagtagagaatcagacttagtaaaatatggtaacagttcaagggatagatatgctacaacagatactgcaaaaaatagcaataatgaaaaatttattggtgatgaaaaagataagagacctgggtctttagaaacgtgtagaagagaatctaacccaaggcaaaatcaagagttttcttttggcaatttgagagctaaattcttgagaccctctgatgatgaagaactgtcatttcacagcaagggcagaaaatttgaaccacttagttcatcttcagcattggtagctcagggctctttgtgtagtggttttagaaaacccaccaagaacagtgaagaaagattaacatcatggagtcgctctgatgggagaggagacaagaaacattcaaatcaaaagccatcggaaaccagtactgatgaacaccaacatgttccagaagacccaagagaaaaatcacaagatgaagtcttgagagatgaccctccaaaaaaagaacatctacgggatacaaagtctacatttgctggcagtccagagcgtgagtccattcacatcctgagtgttgatgagaagaacaagttgggagccaagattatcaaagcagagatgatggggaatatggaattagctgaacaacttaaagttcaacttgaaaaggcaaataaattcaaagaaactataacacagataccaaaaaaatctggggtagagaatgaagaccagcaagaagtaatccttgtcagaacagatcagtctggaagagtatggcctgtgaacacacccggaaaatctctggaatcacaaggaggaagaagaaagagacagatggtttcaacccatgaggaaagagaaagggtcagatactttcatgatgatgataatctaagcctaaatgatttagtcaaaaatgaaaagatgggaacagcagaaaatcaaaacaagctctttatgagaatggcatctaagtttatgggaaaaacagatggagactattacaccctggatgacatgtttgtctccaaagcagctgagagagaacgtcttggtgaagaggaagagaaccaaaggaaaaaagctattgctgagcatcggagtcttgctgcacaaatggaaaaatgtctgtattgttttgacagctctcaatttcccaagcatcttattgttgcaataggtgttaaggtttatttatgtttacccaacgtacggtctcttactgaggggcactgcctgatagtccctttgcagcaccatagagcagctactttgttggatgaagacatctgggaggagatccagatgttcagaaaatcattggtaaagatgtttgaagataaaggattagactgcatttttttggaaactaatatgagcatgaagaaacagtatcacatggtttatgaatgtattcctcttcccaaggaagtgggtgacatggctcccatctattttaagaaagccataatggaatctgatgaagagtggtccatgaacaagaagttgatagatctctcttcaaaagatatcagaaagtctgtacccagagggttaccttacttctctgtggattttggccttcacggagggtttgcccatgtcattgaagatcagcacaaattccctcattactttggaaaggaaatcataggtgggatgctggatatagaaccaagactttggaggaaaggcatccgagaaagctttgaggatcagaggaaaaaagcactgcagtttgctcagtggtggaaaccatatgacttcaccaaaagtaaaaactattgaggtgtaccttccattttaaaatttttcttgagatcccgttcagttttatttccattgcatctaatgaagcaactgaccctcaggtcacaggcagagagaatcacagcagcagactgctctgggtcagtgacaactgtacatcaggagattgtgttgttttcttcttcacctgctcctatctatggacttcattttagtcaccatggagtaaaaacatatattcgatgatctgctcacattcctgctctctacctacttcttggtattccgaattgttcagttaatttagagaaggccttttctgaagggatatctagaaagcataggaaatccttggttcagagggaagtgggtctgcttcatggttgttaagtctactgtctggcttcttttgcatttttaaaaataagacgatttaattttaatttcataggattttatagaaaagctcttaattttctactagcagtatatagtatcacttctattctttttgttaaaggaaaaggaaatgtccccaaagtattaaagaattaaatgatactgaaaatttgtatgattcaaaaaaaaaaaa

SEQ ID NO: 219 - DNA, 2339 bp, Homo sapiens
  CDS (210)..(2003)
ttccaaggcccggcagcctcagtccactgctgggcctggaacacggagcagtggctgccctgcgaggaggtcctagagcagctccagcaggatggcggctccagcgtctctaaggcctgcagggggtccagccccatggggggcgccctaggcctccgacagctccccatctgtgctcctgcctgccggccatcctcaggccactcgccatgggcggctgcttctccaaacccaaaccagtggagctcaagatcgaggtggtgctgcctgagaaggagcgaggcaaggaggagctgtcggccagtgggaagggcagcccccgggcctaccagggcaatggcacggcccgccacttccacacggaggagcgcctgtccacccctcacccctaccccagccctcaggattgcgtggaggctgctgtctgccacgtcaaggacctcgagaatggccagatgcgggaagtggagctgggctgggggaaggtgttgctggtgaaggacaatggggagttccacgccctgggccataagtgtccgcactacggcgcacccctggtgaaaggcgttctgtcccgtggtcgggtgcgctgcccctggcacggcgcctgcttcaacatcagcactggggacctggaggacttccctggcctggacagtctacacaagttccaggtgaagattgagaaggagaaggtgtacgtccgggccagcaagcaggccctacagctgcagcgaaggaccaaggtgatggccaagtgtatctctccaagtgctgggtacagcagtagcaccaatgtgctcattgtgggtgcagagacactgcggcaggagggcttctccgaccggatcgtcctgtgcacgctagaccggcaccttccctacgaccgtcccaagctcagcaagtccctggacacacagcctgagcagctggccctgaggcccaaggagtttttccgagcctatggcatcgaggtgctcaccgaggctcaggtggtcacagtggacgtgagaactaagaaggtcgtgttcaaggatggcttcaagctggagtacagcaagctgctgctggcaccagggagcagccccaagactctgagctgcaaaggcaaagaagtggagaacgtgttcactatccggacgccagaggatgccaatcgcgtggtgaggctggctcgaggccgcaacgtggtcgtcgtgggagccggcttcctggggatggaggtggccgcttacctgacggagaaggcccactctgtgtctgtggtggagctggaggagacgcccttcaggaggttcctgggggagcgcgtgggtcgtgccctcatgaagatgtttgagaacaaccgggtgaagttctacatgcagacggaggtgtctgagctgcggggccaggagggaaagctgaaggaggttgtgctgaagagcagcaaggtcgtgcgggctgacgtctgcgtggtgggcattggtgcagtgcccgccacaggcttcctgaggcaaagcggcatcggtttggattcccgaggcttcatccctgtcaacaagatgatgcagaccaatgtcccaggcgtgtttgcagctggcgatgctgtcaccttcccccttgcctggaggaacaaccgcaaagtgaacattccacattggcagatggctcatgctcaggggcgcgtggcagcccagaacatgttggcgcaggaggcggagatgagcactgtgccctacctctggaccgccatgtttggcaagagcctgcgctacgcgggctacggagaaggcttcgacgacgtcatcatccagggggatctggaggagctgaagtttgtggctttttacactaaaggcgacgaggtgatcgccgtggccagcatgaactacgatcccattgtgtccaaggtcgctgaggtgctggcctcaggccgtgccatccggaagcgggaggtggagctgtttgtgctgcacagcaagactggcgacatgtcctggcttacggggaaaggatcctgagctcacatgcagtagacttgggcaggcaaagggggcaccaagggcacaggccaagccttgggggcaggtgccaatctccagtcccaggatcccccagggcagaacctgagccctcccagtgcttgccttcagccacctggctcccctcctgggaggcctctgctggatccagaagatgctcaaccctcaaggcctctgctgccactgacagctggcactggaggcaggacaagccctgcctcttctccctctattgggactggtcccctgaagaaccctgcaacatgttagacattaccgtaaaattaaaacgcacaaatttgcagaaaaaaaaaa

SEQ ID NO: 220 - DNA, 4204 bp, Homo sapiens
  CDS (398)..(2593)
gattcttttgttcatccagctaatgaaatgaggattggggaacttcacccttcattagctgagacccctctgtacccacccaaacttgttctgctagggaaggacaaaaaaagaatcaactgatgagtctgaagttgacaaaactcactgtctgaataacagtgtttcctcaggcacttactcagactactcgccttcccaggcttcctcaggatcctctaatacccgggttaaagtggggtccttgcagacaacagctaaagatgcagtacataattctttgtggggtaacaggattgcaccatctttcccacagcctcttgattcaaagccattactcagccagcgggaggctgttcccccaggcaatataccacagcgtcctgaccggctgcccatgagtgatactttcactgacaactggactgatggctcgcattatgacaacacagggtttgttgctgaggaaaccacagccgagaatgccaacagtaatcctctcttaagttcgaaatctagaagcacatcttcgcatggacgcaggcctttgatcaggcaagacaggattgttggtgttcccctggaactcgagcagtctacacacagacacacaccagaaacagaagtgcctccttccaatccttggcagaattggaccagaacccctagtccgtttgaagacaggaccgcttttccttccaaattagagacaacccccactaccagcccattgcctgaaaggaaagaacatataaaggaatctactgaaatacctagtcctttttctccaggcgtaccatgggagtatcatgattccaatcccaacaggagtcttagtaatgtcttttctcaaatccattgccgcccggaatcttctaaaggtgttatttcaattagcaaaagcacagagaggctttcccccctaatgaaagatatcaagtctaataaattcaaaaagtcacagagtatcgatgagattgacattggtacatataaggtgtataacataccattagaaaactatgcttctgggagtgatcacttaggaagccacgaacgaccggataagatgctgggaccagagcatggtatgtccagtatgtctcgaagccagtcagtcccaatgctggatgatgagatgctcacctacggaagtagtaaggggccacaacaacaaaaagcttctatgacaaaaaaagtctatcagtttgaccaaagcttcaatcctcaaggatcagtggaagtgaaagccgaaaagaggataccacccccttttcaacacaatcccgagtacgtgcaacaggccagcaaaaacatcgccaaggatttgattagtcctagagcttacagaggatacccaccgatggagcaaatgttttcattttctcagccatctgtgaatgaggatgctgtggtgaatgcccagttcgcaagccaaggggccagggcgggcttcctgagaagggccgactccctggtgagcgccacagaaatggccatgtttagaagggtcaatgagcctcatgagctgcccccaactgataggtacggcagacccccatataggggagggctggatcgccaaagcagcgttacagtgactgagtcccagttcctgaaaaggaatggcaggtatgaagatgaacacccttcatatcaagaagtgaaagctcaggcgggaagttttccggttaaaaaccttacccaaaggaggccattgtctgcgagaagctacagtacagagagttacggtgcctcccaaaccaggccagtttcagctaggcctactatggcagctcttttggaaaaaataccatctgactataacttgggtaactatggtgacaagccatcagataacagtgatttaaagacgaggcctactcctgtgaagggagaggagagctgtggtaaaatgcctgcagactggagacaacagctgcttagacatatagaagctagacggttagacaggaccccgtcccagcaaagcaacattttagacaatggacaagaagatgtatctcctagtggccaatggaatccttatccacttgggaggcgggatgtacctccggacaccattactaagaaggcaggcagccacatccagacgttgatggggtcccaaagccttcagcatcgcagccgggagcagcagccgtatgaaggaaatataaacaaagtgaccatccagcaatttcagtcaccattgcctattcagatcccctcttcacaggccacccggggacctcagcctggacggtgcttaattcaaactaaagggcaaaggagtatggatggatatccagagcagttttgtgtgagaatagaaaagaatcctggccttggatttagtatcagtggtggaattagtggacaaggaaatccattcaaaccttctgacaagggtatctttgttactagggttcagcctgatgggccagcatcaaacctactgcagcctggtgataagatccttcaggcaaatggacacagttttgtacatatggaacatgaaaaagctgtattactactgaagagtttccagaacacagtagacctagttattcaacgtgagcttactgtctaaatattttttataaatagtgaagatacgtctagccagacctaatgttcaaaaataaatttatacatagaaacaaattttgccaattgctggaccaatggcaaacattagtgccaaatgtataatactatatgttagcactgaccatccttaaaaaatgttaactctataaatatgatgttcatgtggttatgtattagttttaattgtcagcctctggctgtgcattggtgcagttttgtttctgtttttgtttttgtttttaatcaaataagtttcttctcaaaatggatttcatataatttcggagcacggaagcacacacaagctctttatgaattctgctctccatcagaaacactgcctcaaagttgtatatgcctttatatagaaaatacaaatataaagaattgtaattcccataaaatatttctagcacaaggtatatgttggcatatatacaaaaagaatatagagaaaaacaatattttcataaactaaacatctcagatagagaaaaaatatatcttaaaataagactttactatattgaatctttttcaataaaaattacatgataatgccttatgaaagtaactgtacatatggtataaagtgtttatatttggttccatattcatttgctaaattctcatgacacagagtgaaatatttcataaattagccatttatctctgggacccaaataaaaataggatgaactaatttgttcaatgcctttagctaattacaatacatgcagagtttagaaacagactaaaggtcattgtagttaagtctttttcaccacaaatttaagcagtggatgatgggtggcaggaaaggtattgctttatttctttcaagttcatgttgattataaactgtagcccctgtgatttctttacttgtaaatgtggaatttatttgtgtgttgcttaatctaatttgctgctttttaaattatttaaaacgaattttggaaattgataaaatttatcattacgaaagactgctgttagaaagttatggtaggtgattttaaatccttggtatttaaatatgaaacttcaaatataatttctcagagctgtggtctacctgtatcattaatttcaatggctgtttttctgggcagaaatagataaaatactttttttccaaaaacagtttcaaggtatgtaaaatcctgaatgctttttcactgaagagaaagacaagcatggttaatgtagaattatttacttttccattgaaactattttcctgcataaatgatcaaaatttattttataatcctttaaaatacttatctttcatattagtcattaatttaattacaatattaatttgaatttccaggataatttcccggagttggttgcatgcattatctttcataattttacatagttcttttgttatataatgaatttactttacatgctagtgtttcaagtattgtatgaggattttcacaatagtatcactgaatgatgtcaccagagctctgagaataatatttgtaagttaactgttttatggggacattgaaaatattgtatttttgtagggtctattaaaatgagtgtcacttattagaaaaaaaaaaaa

SEQ ID NO: 221 - DNA, 1797 bp, Homo sapiens
  CDS (15)..(1787)
cgacgatttcgtcgatgctggcgcaggtttcaccacacgggaagctgtctgcccggcgctcatgggacctgctctcaggctttcccaggtacctggttctggagcacgtctcggggggtgagctattcgactacctggtaaagaaggggagactgacgcccaaggaggcccgaaagttcttccgccagattgtgtctgcgctggacttctgccacagctactccatctgccacagagacctaaagcccgagaacctgcttttggatgagaaaaacaacatccgcattgcagacttcggcatggcgtccctgcaggtgggggacagcctcctggagaccagctgcgggtccccccattatgcgtgtccagaggtgattaagggggaaaaatatgatggccgccgggcagacatgtggagctgtggagtcatcctcttcgccctgctcgtgggggctctgccctttgatgacgacaacctccgccagctgctggagaaggtgaaacggggcgtcttccacatgccccacttcattcctccagattgccagagcctcctgaggggaatgatcgaagtggagcccgaaaaaaggctcagtctggagcaaattcagaaacatccttggtacctaggcgggaaacacgagccagacccgtgcctggagccagcccctggccgccgggtagccatgcggagcctgccatccaacggagagctggaccccgacgtcctagagagcatggcatcactgggctgcttcagggaccgcgagaggctgcatcgcgagctgcgcagtgaggaggagaaccaagaaaagatgatatattatctgcttttggatcggaaggagcggtatcccagctgtgaggaccaggacctgcctccccggaatgatgttgaccccccccggaagcgtgtggattctcccatgctgagccgtcacgggaagcggcgaccagagcggaagtccatggaagtcctgagcatcaccgatgccgggggtggtggctcccctgtacccacccgacgggccttggagatggcccagcacagccagaggctggcaaaacgctcctggttcgggaacttcatctccttggacaaagaagaacaaatattcctcgtgctaaaggacaaacctctcagcagcatcaaagcagacatcgtccatgcctttctgtcgatccccagcctgagtcacagtgtgctgtcacagaccagcttcagggccgagtacaaggccagtggcggcccctccgtcttccaaaagcccgtccgcttccaggtggacatcagctcctctgagggtccagagccctccccgcgacgggacggcagcggaggtggtggcatctactccgtcaccttcactctcatctcgggtcccagccgtcggttcaagcgagtggtggagaccatccaggcacagctcctgagcactcatgaccagccctccgtgcaggccctggcagacgagaagaacggggcccagacccggcctgctggtgccccaccccgaagcctgcagcccccacccggccgcccagacccagagctgtttctattttatttattgattaatttattattttatttattgatcaatctctctgcggggtggggtgggggagggacgggagctggttggggtggcttagcagatccggacagggccctctgtccctgtgtcgtccccaaccccctcttcccgggcccctcctcccctggtcctccccccacgaccttctgtacggatttgctctccggaaggaattctggtttcgcgtgaaaaaaaaaaa

SEQ ID NO: 222 - DNA, 1604 bp, Homo sapiens
  CDS (1)..(1014)
atggagactatgcgagcgcagcggctgcagcctggtgtgggcaccagcgggaggggcactctccgagcgctgcggcccggagtgactggggccgcggctgccaccgccacaccccctgcgggccccccgcctgccccgccgcctcccgcaccgcccccgccgccgctgctcctgtctggggccccaggactacccctgccccccggcgccgccggcagcccggcagtgctgcgagaggccgtggaggccgtggtgaggagcttcgccaagcacacgcagggctatggccgagtgaatgtggtggaggcacttcaggaattctggcagatgaagcagtcccgtggtgctgacttaaagaatggggctctagtggtttatgagatggttccctccaacagccctccttatgtctgctatgtcaccctgcctgggggaagctgctttgggagtttccagttttgccccacaaaagctgaggcccggaggagtgctgcaaagattgcgctaatgaattctgtgtttaatgaacatccttcccgaagaatcactgatgagttcatcgagaagagtgtctctgaggccctggcatcttttaatggcaacagggaggaagctgacaacccaaatacagggattggtgccttccgattcatgctggaatccaacaagggcaaatcaatgttggagttccaggagctaatgacagtttttcaactgctacactggaatggcagccttaaggccatgagggaacgacaatgctctcggcaggaggtgttggctcattattcgcaccgggccctggatgatgatattcgccaccaaatggccttggactgggtgagccgggagcagagtgtgccgggggcactgtctagagagctggcctctactgagcgggagctggatgaagcccgactggcaggcaaggagctgcgcttccacaaggagaagaaagatattcttgtgctggctgctgggcagttgggcaatatgcattcttccaactgctaggcatccacccacataactccccaggctttccacagccttttttttatgtctcctttctaagatttaggatgattttttgtacatactttctcatttttatactttaaaaaatatatatgtgtataaattctacacctagattcctatttgctaagagatcccttttcttactaccagtttttggatgtagttttatttgaaacatcttcagtccactttacaacaaagagcagcttgtctttgcagctttgttagctcttaaacttccagattaactgtgtagccatttcagtagcactaaaagattaactctagtgttcatgtgtccttcttttcaaatatcaggtaacttgaataaggattatgtgccccacccttactctcattcctgcttcctcttggactcaaacagggtatgagtatgaagattttgcctttagttcctgaactgaacctgcttgctatccctttcctccccaccactaccttattccttctctgcctccaaattgccactttgttttgaggcttccttccctaccttattattctgaaggaagtagagatcttgcttctgaaacccctcctaa

SEQ ID NO: 223 - DNA, 2494 bp, Homo sapiens
  CDS (49)..(723)
ggccctgcatactcacatctgacggagtttgcaccacccccaactcccatggtggatcacctggttgcatccaacccttttgaagatgacttcggagcccccaaagtgggggttgcagcccctccattccttggcagtcctgtgcccttcggaggcttccgtgtgcaggggggcatggcgggccagagacctggtcaggggctccccagcctgccgcctaacacaagtccctttcctggtccggaccctggctttcctggccctggtggtgaggatggggggaagcccttgaatccacctgcttctactgcttttccccaggagccccactcaggctccccggctgctgctgttaatgggaaccagcccagtttccccccgaacagcagtgggcggggtgggggcactccagatgccaacagcttggcaccccctggcaaggcaggtgggggctccgggccccagcctcccccaggcttggtgtacccatgtggtgcctgtcggagtgaggtgaacgatgaccaggatgccattctgtgtgaggcctcctgccagaaatggttccaccgtgagtgcacaggcatgactgagagcgcctatgggctgctgaccactgaagcttctgccgtctgggcctgcgatctctgcctcaagaccaaggagatccagtctgtctacatccgtgagggcatggggcagctggtggctgctaacgatgggtgacgctggtgaagtggcccagggaagtgcacatgtctctccctgctcttccagggtgatttttttgatgtttggctcttggtccttgtttccactggctttccatccccatggggcagaaacagtggctcctgggagcagaaaaggaattgaggtgggcaggcagaagagcctggattgctcactgttttgggaaacttacatgttgagatctacagatatccatgaaactaaagccctgctgagcagagccattttgtggctatttctggaggcccaggagtgtggctgcaagagaaaaggggctggaggaagatccggagggcaggggtgttccctctgctgatgatggatgcccctaacacctgtgcctaacacccctactgaaccccacagctccagccttagtttttggagtcaagtgttaaaggtttctggccagaggaattggggtcttgccatccctgcaatagcccttttatgggctctgggagacagctttagggaataaatggggattttcccctttttctacccactcctttgcttcctccaagacttacccaactccttccccctcagagaaccaaatagcctgaggaagcaggagagttcctggttatggcagtttcttggtgatttggggcttcaagacagtaggtgagagatgctgtcaggacgtatcttcttcataccaaagtcactggtcctttctcagcctctctcgtgcttttctcctaatgaccatatttttgccaaaaattgggatatgttatctgacagaccagaatatttgaagtttgggctgtcctgaaagtctggactttggtggtaccctcctcccccagcccatctgttgcacattatactccgtgtgttcttcaactttcggcgcccttattcccctgccttcctggcttgattgaaggaaagcttgaaaaggcgcagagccctatacctcatttcctccatgataaaaggatccaagtgaggccctgtcacagcctgtgggtaggggatgcggcgggatcctcattgccatggtactcaaaggtagaagagcctggagtttgttgcttctctttgctattctttcatatcctcttgggcctggtgattaattagcaattctcattcctctcagccaaaggcctgcactgggctttatttgtctttttttattttttaagcactgcctgccagagatgggcctggggcctgatgaggaccttagcgctgctcgttctccttttctgttcatgcacacattcctccatggggtggggggtggggaaggcaggcatggggtgtggccctcggagaagttaggagtcccccagctcaagatacagtggcaaagacctagtggtcccctacccccacttctctcagttcctggcatgaggagagaagaccctgctctggtggagctgacaacctttgaggctgggaggagagcagcctctgggcatcgttcccagtgtccctcacactaaaacggcgtagatggcaaccccccacccccaccccgctgctcaactcttgtgtttgttgttctgtttgccccatttatctgttgctgtttttgtgttgtcttcccctgctccgcattttgtaaaatggcccctgggggagtgtttttgctggatctgctccctctcgctctctcactccactactttttggaacaaagtgatggcagaatgcggtggtggtgggggtcttttgtactgttggattaataaaatgattttaaaatcccaaaaaaaaaaaa

SEQ ID NO: 224 - DNA, 5064 bp, Homo sapiens
  CDS (24)..(4253)
cggctggcagctgtggcgccgacatggctgcgctggtggagccgctggggctggagcgggacgtgtcccgggcggttgagctcctcgagcggctccagcgcagcggggagctgccgccgcagaagctgcaggccctccagcgagttctgcagagccgcttctgctccgctatccgagaggtgtatgagcagctttatgacacgctggacatcaccggcagcgccgagatccgagcccatgccacagccaagagcgttgagggtgagcagcatgagaaggcggtggagctgctgaaggcggcccagggctcggtgaagctggttgtccgttacacaccgcgagtgctggaggagatggaggcccggttcgagaagatgcgctctgcccgccggcgccaacagcatcagagctactcgttcctgggactccagctgctccctgaggatccagggcttctgaattttcctattctggtcgccgtggggaccatggcacccggggatgcagctcccaccccgttcgggaagcctgtccgtgtctacacctctgctggccccaggaaccaggtcttcacagcctcatcactctgccccatcaacttcacatctcctgtggccctaccaaacccctgtctcatcctcatgtcaccccaggcccgcaccgccgccatgatgtgcgaggtgatgcccaccatcagcgaggatggccggcggggctcggcgctgggcccggacgaggcgggcggggagctggagcgcctcatggtcacgatgctcacggagcgcgagcgcctgctggagacgctgcgcgaggcacaggacgggttggctacagcgcagctgcggctgcgcgagctcggccacgagaaggactcgctgcagcgccagctcagcatcgcgctgccccaggagtttgcagctctgacgaaggagctgaacttatgtcgggagcagctgctggagagggaggaagagattgcagagctgaaggcggaacggaacaacacgcggctgctcctggaacacctggagtgcctggtgtccaggcacgagaggtcactgcgcatgaccgtggtgaagcgccaggcccagtccccgggtggggtctcctcggaggtagaagtgctcaaagctctaaagtctctcttcgagcaccacaaggccctggatgagaaggtccgggagcggctgcggatggcgctggagcgcgtggcagtgctcgaggaggagctggaactgagcaatcaggagactctgaaccttcgagaacagctgtctaggcggcggtcagggctggaagagccgggcaaggatggggatgggcagactcttgccaatggcctgggtcctggcggggattccaaccggcgcacagcagagctggaggaggccctggagcggcagcgcgccgaggtgtgccagctgcgggagcgcctggcggtgctgtgccgtcagatgagccagctggaggaggagttgggcaccgcgcaccgtgagctgggcaaggcagaggaagccaactccaagctgcagcgcgacctcaaggaggcgctggcgcagcgggaagatatggaggagcggattacaacactggagaagcgctacctgagcgcccagcgggaggccacgtctctgcacgacgccaacgacaaactggagaacgagttagctagcaaggagtcgttgtatcggcagagtgaagagaagagccgtcagctggccgagtggttggacgacgccaagcagaagctgcagcagacgctgcagaaagcggagaccttgcccgagatagaggcgcagctggcgcagcgcgtggcggcgctcaacaaggccgaggaacgtcatgggaattttgaggagcggcttcggcagctggaggcccagctggaagagaagaatcaagagctgcagcgggcccggcagcgggagaagatgaacgatgaccacaataagcggctgtccgagacggtggacaagctgctgagcgagtccaacgagcgcttacagcttcacctcaaggagcgcatgggggcgctggaggagaagaactccctgagcgaggagatagccaacatgaagaagcttcaggatgagttgctgctaaacaaggagcagctcttggccgaaatggagcggatgcagatggagatcgaccagctgcgggggaggccaccatcctcctactccaggtctctccctggcagtgccctggagctccgttactctcaggcacccactttaccttctggtgcccacctggatccctatgtggctggcagtggtcgggcaggcaagaggggccgctggtcaggggtcaaggaggagccctccaaggattgggagcggtctgccccttcgggctccataccacccccattccctggggaactggacggctccgatgaggaggaggcagaggggatgtttggggccgagctgctgtcccccagtgggcaggctgacgtgcagacgctggccatcatgcttcaggagcagctggaggccatcaacaaggagatcaagctgatccaagaggagaaggagacaacagaacagagggcagaggagctggagagtcgggtgtccagctctggcttggactcgttgggccgctaccgcagcagctgctccctgcccccctccctcaccacctctacccttgccagcccctcccctcccagctctggccactcaacaccccgcctggcaccccctagccctgcccgtgagggcaccgacaaggctaatcatgtccctaaggaggaagctggagctccacgaggggaggggccggccatcccaggagacaccccaccacccactccccgctctgcccgtcttgagagaatgacccaggccttggcactgcaggcggggtccctggaagatgggggacccccacggggaagtgagggcaccccagattctctgcacaaagcccccaagaagaagagcatcaagtcatccataggccgtctctttggcaagaaagagaagggacgaatgggacccccaggccgggacagctcttctctggctggaacaccctcagatgagacactggccactgaccctctggggctagccaagctgacaggcccaggagacaaggaccgaaggaacaagaggaagcatgaactcctggaggaggcctgccgccagggcctaccttttgctgcctgggacgggcccaccgtggtgtcctggctggagctgtgggtgggcatgcctgcctggtatgtggccgcctgccgggccaatgtcaagagcggtgccatcatggccaacctgtcagacacgaagatccagcgcgagatcggcatcagcaacccgctgcaccgactcaagctacgcctcgccatccaggagatggtctcgctcacctcgccctcagcccccgcctcctcccgcacttccacaggaaacgtgtggatgacacacgaggagatggagtcccttacggccacgaccaagcccgagaccaaggagatcagctgggagcagatcctggcatatggcgacatgaaccacgagtgggtggggaacgactggctgcccagcctggggctgccccaataccgcagctacttcatggagtcgctggtggacgctcgaatgttagatcaccttaacaagaaggagctccggggccaactcaagatggtggacagctttcacagggtgagtctacattatgggattatgtgcctgaaacggctcaactatgaccggaaggacctggagcggaggcgggaagaaagtcagacccagatccgagacgtgatggtgtggtccaatgagcgggtcatgggttgggtgtccgggctgggcctgaaggaatttgccacgaacctcacggagagcggggtacacggggcactgctcgccctggacgagaccttcgactactccgacctggccttgctcctgcagatccccacgcagaatgcacaggcccggcagcttctggagaaggaattcagcaaccttatctccttaggcacagacaggcggctggacgaggacagcgccaagtctttcagccgctccccatcctggcggaagatgttccgggagaaggacctccgaggcgtaactcccgactcagctgagatgttgccccccaactttcgttcggctgcagcgggagccctgggctctccggggctccctctccgcaagctgcagccagaaggccagacttctgggagttcccgggcagacggcgtttcggtccggacctattcctgctagtgcaggcctccaggtgacctcactcggacggaagaatcttcccgaggctgggctgttccctctcctgcccggactgtggcctcgccggggagagcgggcgggggagctcgcgccgaggactggaccatctgtacagaccagcgggagtgcgcgcgcccgcctcgcacagggccggggcctggaccaaaccacatgaactggactgagagggggaagaagcggggaggaagaaatcccgccccaaacgtccgctttccttttctctactttgtaatttattgatcagtttctgttgggagacgggtgtcctttacccgcgggaagggggcggggcttccctcccgggccgcatgcggggagaggctgctccctcccctttttcctgcccagtcgcggggcccaagtcttccttcttcgtccgaaaggaggggaggggggactcgctgctacaagcctcgccccctgtgccactcagctccgccccgccgcgtccggtcgccggtcccccgggtcatctgcgggcggggtcccctctccctcccccgtgtctcgtgtccccggggcctcaccgccccccgtgctgtggccgtgtccgtgccccgggggtagggggcgcagaatggcgcttccccttctcctctggctccggggtttgcatgggagaatcctctttccacgatgccgctgggcgacgtggcgtgggggcagggggacggtgggggagccctcgcccccgactctcggtcggcctccccgccccaggcgtcactcagtgatcacgggtaaagagaactgtttcaaaaaaaaaaaa

SEQ ID NO: 225 - DNA, 3410 bp, Homo sapiens
  CDS (218)..(2437)
ggacgggcatctggaatcgctgcctctggctttctgttttctactaacaggatttggtcactggttcttcatcttttgtctgttgcacgcatcccgccctccccacttgcttccccactccttggatccagccctgtgggcattcacgtcagttctctgaccccgccgtgagccccgctccgggtccccgggcgggcttggcacggaggcggtaactatggagaatatggcggaggaggagctgctgcccctggagaaggaggaggtggaggtggcccaggtccaggtcccgaccccggcccgggactcggctggggtcccagctccggccccggattcggctctggactcggctccgactccggcctcggctccagccccagcccctgccctggcccaggctccggccctgtccccgtccctagcctctgcccctgaggaggctaaaagcaagagacacatctcaattcaaaggcagcttgctgatctagagaatttagcttttgtaactgatggaaattttgactctgccagctcattgaactcagataatcttgatgcaggcaacagacaggcttgtccattgtgccctaaggaaaaattcagagcttgtaatagccataagcttcgtcgtcacctccagaatttacactggaaagtctcagttgaatttgaaggttacaggatgtgcatctgtcacttaccttgtcgaccagtgaaaccaaacattattggagaacagataaccagtaaaatgggagcccattatcattgtatcatttgttcagcaacaatcaccagaagaactgatatgctaggacatgttaggcgccacatgaataaaggagagactaaatctagttatattgcagcttccactgctaaaccacctaaggaaattttgaaagaggcagacacggatgtacaagtttgtcccaactattctatacctcagaaaacagattcctattttaaccccaaaatgaaactaaatcggcagctaatattctgtacattggctgctttggctgaggaacgaaaacctttggaatgtctagatgcttttggagccactgggataatgggattacagtgggcaaaacatcttggaaatgcagtcaaagttacaatcaatgacttgaatgaaaattctgtgacactgattcaggaaaactgccatttaaacaaattgaaagtggtggtggacagtaaggaaaaggaaaagagtgatgatattcttgaagaaggagagaaaaatcttggtaatattaaggtgaccaaaatggatgccaatgtactgatgcatttgagatcttttgatttcatacatctagacccttttggaacatcagtgaattatctagattctgcattcagaaatataagaaaccttggcatagtgtcagtgacttctacagatatcagttctttatatgccaaggcacagcatgttgcccggcgtcactacggatgtaacattgtccgaactgaatattacaaggaactagcagccagaattgttgtagctgcagtggcaaggtaccaaattgccaacagtgtacttacccgatgcaacaaaggcatagaagtactgtttgcagtggctctggaacattttgtgttggtagttgtgagagttttgaggggacctacttcagcagatgaaacagccaagaagattcaatacctgatccattgtcagtggtgtgaagagagaatttttcagaaggatggtaatatggtagaagaaaacccatatagacagctgccttgtaactgtcatggaagcatgcctggaaagacagcaatagaacttggacctctgtggtcaagttcccttttcaatactggattcctcaaaagaatgctatttgaatctcttcaccatggtttggatgacattcagaccctaataaagacattaatctttgaatcagagtgtacgcctcaaagtcagttttcaattcatgcatcttcaaatgtcaacaagcaagaagaaaatggtgtatttattaaaactacagatgacaccacaacagataattacattgcacaaggaaagagaaaaagtaatgaaatgatcacaaatttaggcaagaagcaaaagactgatgtcagtactgaacatcctcccttttattacaacattcacagacacagcattaaaggaatgaatatgccaaagttaaaaaagtttttgtgctatttatctcaagcaggctttcgagtaagccgaactcattttgacccaatgggtgtacgcacagatgcacctctgatgcagtttaaatctatccttttaaagtacagcacccccacctacactggaggacagtcagaaagccatgtccagtcagcatctgaagatacagtaactgaaagagttgaaatgtcagtgaatgacaaagcagaagcaagtggctgcagaagatggtaaacgtagagaagaattggttctcaggtgtctgtatagatggcctaatagttctctataccaactgtagttctttttctgttctttcaattcagtagagtaaaaataaaaaacagtgtcattttcattcagaaactgagcagtttctaacttagctggtttgggagctttgctttccaagtttttttttgttttaaggcaaacttaaaattttaatggaaacatttcatatgaagccaagtctcactgagatcaccctactgcttaataattcagaaaattttcacatgcaaagtgtttggaattttatgtatgttatgaaagccatcttttacaattcttaatcacatctctgcctaaactgattcatgatgtttatgttttcctgtttgtagtgtacaaaatgaagctgaaggctcacatgttaaaatgaccctgaatagaataggaagaacaatgttcttacaggtcataatgtatttcacaattaaaaaactaaaatatgtacccatttttaagaaatcatacttctctccacattgatcttttcatttcttactagcttttaagaaattaaatacttgcctgagatagaaatactttatttttgtaactttaaggtctaaatgactaaacttcaaagtaagattttgtcagaataaattgagaccattaatctaatataatacttgttcatgagcactgaaatcctgaagaggagagatttggttataaattaaaaaggttgggtgatcttaagtgcctcagttaatgcacgtacagtattcatttggttggttgtactacctctcagaagtaaaatttgtcaccttatggaatgagagtttttgggtttgggggttgtttttttgttgttgcttggtttggtatttttggttttgtgtgtatttgtataaattttctgtataattagcccaggctgatgtaactataaaaattagttgaaaaaaaaaaa

SEQ ID NO: 226 - DNA, 3137 bp, Homo sapiens
  CDS (293)..(2584)
cgccgcccgacagcgcgcccggaacatgccagcctcgcgcagcctgcgctgacttccccgagacgcgccgcggtcggcacggagactttctgggctctggatggttcgtgcgctgctcaccctcgcccacccctgacgccgcggaccgcagctcctcagccccgcagccccgcagccccgcagcccagcagccccgcagcggcgccgaggacagtgcagccgagttgcgtctccctcgcgcgagcagccattgtttgatgtcctgtgactgagaaaccaggctttaaactttatgcctttggagatggagcccaagatgagcaaactggcctttggctgtcagagaagttccacatcagatgatgactctggctgtgcattggaggagtacgcctgggtccccccgggcctgagaccagagcagatccagctctattttgcttgcttaccagaggaaaaagttccttacgttaacagccccggagagaagcatcggattaaacagcttttgtaccagttaccaccacatgataatgaggtacggtattgccagtctttgagtgaagaggagaaaaaagagttgcaggtgttcagtgctcagcggaagaaagaagcactgggaagaggaacaattaagcttctgtccagagcagtcatgcatgctgtgtgtgagcagataatttttgctgatgagtgcacagaagctgagggtcgccattggcacatgaaacacttctgctgccttgagtgtgaaacggtcctgggaggacagaggtatatcatgaaggacggccgccccttctgctgtggctgttttgagtctctctatgcggagtactgtgaaacctgtggggaacatattggtgtggaccatgcacagatgacctatgacgggcagcactggcacgccacggaagcctgcttttcttgtgcccagtgtaaagcctctttgttgggatgtcccttccttcccaaacagggtcagatttactgctcaaaaacgtgcagtcttggtgaagacgtccatgcctctgattcttccgactctgcatttcagtcagctcgatcaagagactcccgaagaagtgtccgaatgggcaagagcagccggtcagcagatcagtgtagacagtctctcctcttatcgcctgctctgaactacaagtttcctggcctctcaggcaatgctgatgacaccctttctcgaaaattggatgatctgagtctctccagacaaggaacaagttttgccagtgaagaattttggaaaggcagagtagagcaggaaactccagaagaccctgaagaatgggctgatcatgaagattatatgacgcagctcctcctcaagtttggtgataaaagcctctttcagccacagcccaatgagatggatattcgagccagtgagcactggatatctgataacatggttaaaagtaagaccgagttaaagcaaaataaccagagccttgcaagtaaaaaataccagtctgatatgtactgggcacagtcacaagatggactgggcgattctgcttatggcagccacccaggccctgcaagcagtagaaggcttcaggaattggaactggaccatggggcttcagggtataatcatgatgaaacacagtggtatgaagattccctggagtgtctgtcagacctgaaaccagagcaaagtgttcgggattcgatggattctttggcattgtccaatatcacaggggcttcggtggatggagaaaacaagccaaggccatcattgtattctctgcaaaattttgaggagatggaaacagaagattgtgagaagatgagcaatatgggaactttgaactcttccatgctgcacaggagtgcagagtccttaaagagtctaagttcagagttgtgtccagagaaaatcctgcctgaagagaagccagtacatctgccagtgctcagaaggtccaagtctcaatccagaccccagcaggtcaagttttccgatgatgtcattgacaatgggaactatgacattgaaatccggcagcctccgatgagtgaaaggactcggagacgcgtctacaattttgaagagaggggatccaggtctcatcaccaccgccgccggagaagtagaaagtcccgctccgacaatgccctgaatcttgttacagaaagaaaatactctcccaaggacagactgcggctgtacacccccgataactatgagaaatttatacagaataaaagtgcccgggagatccaagcatacatccagaatgctgatctctacggacagtacgcccatgccacttccgattatggcctgcagaacccaggaatgaatcggtttctgggactctacggcgaggatgatgattcctggtgttcttcctcctcctcctcttccgactcggaagaagaaggatattttcttggacaaccaatccctcaaccccggccacagagatttgcctactatacagatgacctttctagtccaccatctgcacttcccacccctcagtttggtcagaggacaacaaaatccaagaagaaaaagggacacaagggcaaaaattgtattatttcttaaccaagtagtgatgcagagcatttgtttaaaacttagccattaaccgtctgaatcgtttccttttcttccgtaggaaagttgtgaaaatagcttaaagtgctttctttgcccatgtaaatgagaactcaactgctgtttacagtgtcagattaacatttgaaaggtgtgatttctccaatttaccctctttggatggtgccaggtggacgtgacatctcgtgcctgtccggtgcgggtgcgttacagatggacgtagctgctttggttttccagtcctcaagggaatactgaagatgctgactgaaggggattggatgttgattttagaagatggagaactccagccacctttgtaaagcactagtgtttgtcatttatgtaagtcaggtcggctcaggtcttgatagtccgtcttggtgtgaggcatgcctgtcacgatgacctagctaacactgtgcatcttattgtgaggccagcttgtcccctcgaaccctctttggccaggtaaacattgtattgtatcagctccagctacagattgaaaaaaaaaaaa

SEQ ID NO: 227 - DNA, 1248 bp, Homo sapiens
  CDS (261)..(875)
  misc_feature (1)...(1248): n = a,t,c or g
aaggatccttaattaaattaatcccccccccccccccgagtcggaggcggccggctgggcgtgcgctcgctccccgaagccggggctgggccggagccgggcgagggctgggagctgggccgggtccggggacagcgggcgaggggcagctgccggagccgggcagccaggccgctcagggcaggggacagctggcgccggttctgcggtctccggggcccagatgtgaggcggcggcgcccccggcccgagagcgcacgatgggggccccgctcgccgtagcgctgggcgccctccactacctggcacttttcctgcaactcggcggcgccacgcggcccgccggccacgcgccctgggacaaccacgtctccggccacgccctgttcacagagacaccccatgacatgacagcacggacgggcgaggacgtggagatggcctgctccttccgcggcagcggctccccctcctactcgctggagatccagtggtggtatgtacggagccaccgggactggaccgacaagcaggcgtgggcctcgaaccagctaaaagcatctcagcaggaagacgcagggaaggaggcaaccaaaataagtgtggtcaaggtggtgggcagcaacatctcccacaagctgcgcctgtcccgggtgaagcccacggacgaaggcacctacgagtgccgcgtcatcgacttcagcgacggcaaggcccggcaccacaaggtcaaggcctacctgcgggtgcagccaggggagaactccgtcctgcatctgcccgaagtccctcccgccgcggccgccacgccgccccccaagccaggcaaggagctgaggaagcgctcggtggaccaggaggcctgcagcctctagacatgatgcccctggccccggccatccgggcccacgctgtacagagtgcatgaggagccgccggaccacgnnaagctgactgcctgcgtccagccgcgccccatccccgaagctgcgtgtggcaccaatgtcgggcctctttccaacaaccctttggtctagatgtaaggccccaacaacccttgcctttcagaccctgcggtgacttggttggagagngtggcttggaacaaggggcaaacggcttgacaatgggcaaggacatgctgggcccgggcaacccttctggtacagctcagtgggcccaggttttcttggtagatttcccacacccccgaaccagggccccagggtgctccctccctacactctt

SEQ ID NO: 228 - DNA, 1595 bp, Homo sapiens
  CDS (254)..(970)
  misc_feature (1)...(1595): n = a,t,c or g
agaggcgttcccgcgcccggcagggtaggcgcagtgcgcaggcgcccaaagccgacgtggaggtgatgcgcgggagcacagatccggggcagtgcgctgcgcagaggcgcgcggcgaagccgagtgggcgcgggagtgacgtcacggcgcgcgacgcggaggcggggtcgggcctgggcaactcgctgatggcgccggtaggccgctggcagaagggccgcgacctcacctggtacgccaagggccgggcgccatgcgcgggcccgagccgcgaggaggaactggcagccgtgcgggaggcggagcgcgaggcgctgctggccgcccttggctacaagaacgtgaagaagcagcccacgggcctgagcaaggaggacttcgcggaggtctgcaagcgggaaggaggcgaccccgaggagaagggcgtggaccggctgctggggctggggagcgcaaggtgcgggcgggtttccaggggagggcagcactgggctcgattgctcgggtgaggcggacccctgccgtactgtcttcatcgccatgtccctgcagtggctccgtgggccgcgtggcgatgtcccgagaggacaaggaggccgccaaactggggctgtctgtgttcacgcatcaccgcgtagagagcggcgggcccgggacctcggcagcctcggccaggaggaagccgcgggcggaggatcagacggaaagcagttgtgagagccacaggaaaagcaagaaggagaagaagaaaaagaaaaagaggaaacacaagaaagagaagaagaagaaagacaaagagcacaggcggccagctgaggccacctcctctcccacatctcctgagaggcccaggcaccaccaccatgactccgactccaactccccctgctgtaagaggaggaagcggggacacagtggggacaggaggagcccgtctcgcaggtggcatgacagaggctctgaggcctgatggctggaccctgctcactgctgttgtgggaccctgaaccctcccttcaccttgcttgcctcctgcctcggaagctccttgggtgtgggtgaagcccgaggctgctcctgtggaagtggctctgggcaccagcctgtggggctaaagacttgacagctagctctggagcagccggcttcctggaaaacctccaggtttcgcataccagggatggcccctggcttggcctgcgaaggtgaacctgcccagatttatcagtagaggctggactccctctgtgtcctgcccatggttgcagcagccatgggcctatgagcggtctaactgtggccaagtatggtgacctctatttttctttatattgactctttgtatttcaataaatatattttacacaggcaacacaccactcatacaccactacaaaaaacctcgggggcgtcatttgccggcggggcgggagaaggacgggcttggaattggccccttggtcctacgctggtttccttggccccaggttttctttgtccccatgtgggtagaaatctgcggggtccccatatggggggccggataaattncgggcaacgcagggtaccgacgttctcgcctcactgccgccagc

SEQ ID NO: 229 - DNA, 1135 bp, Homo sapiens
  CDS (91)..(1032)
tttcgtctgagccgcccgccgcctggagggggagacagcttcaggacacgcaggccgcagcgagggcccgggccctggggatcccaggccatggatgctccccactccaaagcagccctggacagcattaacgagctgcccgagaacatcctgctggagctgttcacgcacgtgcccgcccgccagctgctgctgaactgccgcctggtctgcagcctctggcgggacctcatcgacctcatgaccctctggaaacgcaagtgcctgcgagagggcttcatcaccaaggactgggaccagcccgtggccgactggaaaatcttctacttcctacggagcctgcataggaacctcctgcgcaacccgtgtgctgaagaggatatgtttgcatggcaaattgatttcaatggtggggaccgctggaaggtggagagcctccctggagcccacgggacagattttcctgaccccaaagtcaagaagtattttgtcacatcctacgaaatgtgcctcaagtcccagctggtggaccttgtagccgagggctactgggaggagctactagacacattccggccggacatcgtggttaaggactggtttgctgccagagccgactgtggctgcacctaccaactcaaagtgcagctggcctcggctgactacttcgtgttggcctccttcgagcccccacctgtgaccatccaacagtggaacaatgccacatggacagaggtctcctacaccttctcagactacccccggggtgtccgctacatcctcttccagcatgggggcagggacacccagtactgggcaggctggtatgggcccgagtacacagcagatggggtagccagatggaccgggccagggtacgcgagggtcagctgcgaaaagactgcaggagagggggccaacgctacgaagcgtggcaaatctggaggccaccgggatgagcaacagaggctcacgagcgaaacacgagggggaaagcccggaaaagcgtggcggagacaacaagggggatgagcaaccacacgcggacaaaacgcagacccagacaacgagagaaggagagcgccgaccagaccgcaacctggagagcacgccagacacaacaacagagaaaaca

SEQ ID NO: 230 - DNA, 1826 bp, Homo sapiens
  CDS (415)..(1764)
agggcgcgctgcccggagctgcctgggttgcgctgccggccacgtccccgcgccgggcctcaggctccttcctactgtccgagggccaccaggccgccgggggcctgctgcgcccggatgcgtctgttactagagtggagagtctaccttcgtctcacatgtgccacaaaggatggcatggcccgggagtgccccaccacgtggctttcaccccctgcaaagccagacttcgcccagcgacacagtgtcaagcccacagctctccaaggaggaagatggtccaggctgggagcatccccttagcagcagcctctgatcccttggccaagcaggagggaaccattagcagcctgaggagctggctggctgggagcctcggggaccgcccagccttgctcccagctcacccacaagatgtggacagctcttgtgctcatttggattttctccttgtccttatctgaaagccatgcggcatccaacgatccacgcaactttgtccctaacaaaatgtggaagggattagtcaagaggaatgcatctgtggaaacagttgataataaaacgtctgaggatgtaaccatggcagcagcttctcctgtcacattgaccaaagggacttcggcagcccacctcaactctatggaagtcacaacagaggacacaagcaggacagatgtgagtgaaccagcaacttcaggagttgcagctgatggtgtgacctccattgctcccacggctgtggcctccagtacgactgcggcctccattacgactgcggcctccagtatgactgtggcctccagtgctcccacgactgcagcctccagtacaactgtggcctccattgctcccacgactgcagcctccagtatgactgcggcctccagcactcccatgacacttgcactccccgcgcccacgtccacttccacagggcggaccccgtccactaccgccactgggcatccatctctcagcacagccctcgcacaagtgccaaagagcagcgcgttgccaagaacagcaaccctggccacattggccacacgtgctcagactgtagcgaccacagcaaacacaagcagccccatgagcactcgtccaagtccttccaagcacatgcccagtgacaccgcggcaagccctgtaccccctatgcgtccccaagcacaaggtcccattagccaggtgtcagtggaccagcctgtggttaacacaacaaataaatccacacccatgccctcaaacacaaccccagagcccgcccccacccccacagtggtgaccaccaccaaggcacaagccagggagccaactgccagcccagtgccagtacctcacaccaggccaatccctgagatggaggccatgtcccccacgacacagacaagccccatgccatatacccagagggacgctgggccaggcacatcccaggcaccggagcaggtagagactgaagccacaccaggtactgattccactgggccaacacccaggagctcagggggcactaagatgccagccacggactcgtgccagcccagcacccaaggccagtacatggtggtcaccactgagcccctcacccaggccgtggtagacaaaactctccttctggtggtgctgttactcggggtgacccttttcatcacagtcttggttttgtttgccctgcaggcctatgagagctacaagaagaaggactacacccaggtggactacttaatcaacgggatgtatgcggactcagaaatgtgaggggggcgggggcctggcgggaggcctggccccttcctcgtcctttccttttgcctttgaga

SEQ ID NO: 231 - DNA, 1501 bp, Homo sapiens
  CDS (410)..(1240)
ttattctacttcagtgtttgtgtggagggggacaatctggttaaagttagtcttgcaagtggtgactttagcatttcccccaacttcatcaagcctttgctcaggagcatgaaacccatcttggaacatatatccaacatctctgagagccttgtcatcattcatgaaaagacgctcaacatcataagtctttagagaaacgcatattcgaatcatttcatatccactagaatcagccgcggttccttcctgcgcctttatctgcatccgggtccgtgggattcgcgctccactggtcagctggggtcgctctcgggtggttgggtgttgcttgttcccgctgttccagcgtcgaagaaccattgggtctgccggtttgaacttgttctggaagctgtgcgtcaccgtaatgaggcttgtaattcttgataactatgacttggctagtgaatgggcagccaaatacatctgtaatcgcatcattcagttcaaacctggacaggacagatattttacactgggtttaccaacagggagtacacctttaggatgctataaaaaactaatagaatatcataagaatggacacctttcttttaaatatgtgaagacctttaatatggatgaatatgtaggacttccaagaaatcatcctgaaagctaccattcttatatgtggaataatttttttaagcatatcgatatagatcctaataatgcacatatccttgacgggaatgctgcagatttacaagcagaatgtgatgcttttgaaaacaaaataaaagaagctggaggaatagatctttttgttggaggaattggtccagatggtcatatcgctttcaatgagcctggatccagtttagtgtcaaggacaagattaaagactctagcaatggataccatcttggcaaatgccaaatattttgatggagatttatcaaaagtgccaactatggctctaactgttggtgtggggacagtgatggatgctagagaagtaatgatccttataacaggggcacacaaggcatttgccctgtacaaagcaatagaagaaggagtcaatcacatgtggactgtttccgctttccagcagcatccccggactatttttgtatgcgatgaagatgctactttagaattaagagttaaaactgtgaaatactttaaaggtctaatgcatgtgcacaataaacttgtggatccactattcagtatgaaagatggaaactgaaggagactggagcaaaattcagcttgaatgaacagagcactttttactaagtagtagatgaattttcagctatgcaatatgacaaaacatggggaattttgaagattgtcattttttcattcgagtctctatgttaaacattccatattttgaatatttatatcttgtacttgggtttaagagaagtagctggctctcaagattgactggctatttattataaagtactgaagtcacatagccacctataaaaaaaaaaaa

SEQ ID NO: 232 - DNA, 2277 bp, Homo sapiens
  CDS (105)..(1457)
aggtttggggaggagttggagcctttgctgagctgacgtggactgctggcagcaggtgcacacattttgaggagctgtgccagggaaacggagacccgggggagatggacgaagacattggtgttgggactggatttgatcccaggccccaggctgcagcgtctgtgctttaccagccctgtggggtcctcaccgtcccgtaccaggagactcagagtaccaggggcttcaggttgtgggtgtgggttatgcatccgggctgtgctaatgggaactgccagctgaagaagacactgagtccagttttggtcatgatggtgaataatgaaatcattatcactgagttcgattttatttccagttcttgtttattgttagtgaaattccgggatgtggaggttcattctggggttcgttcttcccacctggtgaggaagctggccggcagcaactccaaaccatacgaacgttgcctgcgatgccagagtgacgcagatccggggcgggtccgcggccgcggcgggaacatggaggagctgctgaggcgcgagctgggctgcagctctgtcagggccacgggccactcggggggcgggtgcatcagccagggccggagctacgacacggatcaaggacgagtgttcgtgaaagtgaaccccaaggcggaggccagaagaatgtttgaaggtgagatggcaagtttaactgccatcctgaaaacaaacacggtgaaagtgcccaagcccatcaaggttctggatgccccaggcggcgggagcgtgctggtgatggagcacatggacatgaggcatctgagcagtcatgctgcaaagcttggagcccagctggccgatttacaccttgataacaagaagcttggagagatgcgcctgaaggaggcgggcacagtggggagaggaggtgggcaggaggaacggccctttgtggcccggtttggatttgacgtggtgacgtgctgtggatacctcccccaggtgaatgactggcaggaggactgggtcgtgttctatgcccggcagcgcattcagccccagatggacatggtggagaaggagtctggggacagggaggccctccagctttggtctgctctgcagttaaagatccctgacctgttccgtgacctggagatcatcccagccttactccacggggacctctggggtggaaacgtagcagaggattcctctgggccggtgatttttgacccagcttctttctacggccactcggaatatgagctggcaatagctggcatgtttgggggctttagcagctccttttactccgcctaccacggcaaaatccccaaggccccaggattcgagaagcgccttcagttgtatcagctctttcactacttgaaccactggaatcattttggatcggggtacagaggatcctccctgaacatcatgaggaatctggtcaagtgagcgggccttactctggaaggaggcctcagaggtttctccacagtcctcttctgggcaaattcttgtttcttcacatgccggactagcttaagaccaatgcagtagcttatttccaagccttgcaaagtatataatatctaagaggaaaggttttgtcatcccagcgttgtccactttgtggggctttgtaggtagacggagccacactacaggcagggtatgagcagagggatgtatggagtgtgggtgactctgagcctcactgctgctgcaaggtggggaaactgtaagtgaacccctgtgggtgcgggggagggtatccggtgcgcagggaggtggccagcgcccccgggcactgctgctcataggtacctttccgctgcctcctccctgctctcctgtgcaggaatgtctctgagctgttcacgttgatgcttcttggttggcaagacttgggtgtagacatgaaaccatcttactaaaagcgtcttaaaatgaccaattccagaatcaagcgtattccgttttcttcctgcatgatccctgggccctcccgcaggctgagcaagtctgtaaactgattctgggagaaaccaagctgctggccgtaggatgtccttgggtacatccaggagtcttcattgcttctgttattaccccgtctcctctgccattttctacagcttgctgagttgtcattcctttgcaacattaaaatacatgctgaactcatatttttccttccttcactgttgtagtaaagagacatatttcatgaatggcattgatgctaataaatcctttgcacaaaaaaaaaaaa

SEQ ID NO: 233 - DNA, 604 bp, Homo sapiens
  CDS (66)..(512)
ccactgtttaggccaaggccctggggcactagaggcaaagagacacctgacccctttttgcccatatggcggggagagcagcagcggcccaagcaggagctgcagcgagccgggtacctggactcagcggtagcaacctcgccccttgcaacaaaggcagactgagcgccagagaggacgtttccaactcaaaaatgcaggctcaacagtaccagcagcagcgtcgaaaatttgcagctgccttcttggcattcattttcatactggcagctgtggatactgctgaagcagggaagaaagagaaaccagaaaaaaaagtgaagaagtctgactgtggagaatggcagtggagtgtgtgtgtgcccaccagtggagactgtgggctgggcacacgggagggcactcggactggagctgagtgcaagcaaaccatgaagacccagagatgtaagatcccctgcaactggaagaagcaatttggcgcggagtgcaaataccagttccaggcctgaagaccagaactggaagtctgaagcgagccctgcacaatgccgaatgccagaagactgtcaccatctccaagccctgtggcattcggcattgt

SEQ ID NO: 234 - DNA, 1849 bp, Homo sapiens
  CDS (236)..(1750)
ccactctgctcagctccgctccaggaaggccacctcctcctccccctcctcctcccgctgtcaccactcaccgctcataacctcaagggggtggggaccccagggctggacacaccccaccgtggccccagagctcagccggtcgcacggacggacagttggaagccggaccccagagcctgaggtgggcagtgtgccagggtcccttgcggcctcctcaagccctgtccaggctatgggcatcaagacagcattgccggcggctgagctgggcctctactctctggtgctgagtggggccctggcctatgctggccggggcctccttgaggcttcacaagatggggcccacaggaaggccttccgggagtctgtgcgacctggctgggagtacattggccggaagatggatgtggctgacttcgagtgggtgatgtggttcacctcctttcgcaacgtcatcatctttgccctctccggacatgtgctgtttgctaaactctgcacgatggttgccccaaagctccgctcctggatgtatgctgtgtacggggccttggctgtgatgggcacaatgggcccttggtacctgctgctgctgcttggtcactgtgtgggcctctatgtggcctcgcttttgggccagccctggctctgtcttggccttggcttggccagcctggcctccttcaagatggaccccctaatctcttggcagagcgggtttgtaacaggcacttttgatcttcaagaggtgctgtttcatgggggcagcagcttcacagtgctgcgttgcaccagctttgcactggagagctgtgcccaccctgaccgccactactccttagctgacctgctcaagtacaacttctacctgcccttcttcttcttcgggcccatcatgacctttgatcgcttccatgctcaggtgagccaggtggagccagtgagacgcgagggtgagctgtggcacatccgagcccaggcaggcctaagcgtggtggccatcatggccgtcgacatcttctttcacttcttctacatcctcactatccccagcgacctcaagttcgccaaccgcctcccagacagtgccctcgctggcctagcctattcaaacctggtgtatgactgggtgaaggcggccgtcctctttggtgttgtcaacactgtggcatgcctcgaccacctggacccaccccagcctcccaagtgcatcaccgcactctacgtctttgcggaaacgcactttgaccgtggcatcaacgactggctttgcaaatatgtgtataaccacattggtggggagcattccgctgtgatcccagagctggcagccacagtggccacatttgccatcaccacactgtggcttgggccttgtgacattgtctacctgtggtcattccttaactgctttggcctcaactttgagctctggatgcaaaaactggcagagtgggggcccctagcacgaattgaggcctctctgtcagtgcagatgtcccgtagggtccgggccctgtttggagccatgaacttctgggccatcatcatgtacaaccttgtgagcctgaacagcctcaaattcacagagctggttgcccggcgcctgctactcacagggttcccccagaccacgctgtccatcctgtttgtcacctactgtggcgtccagctggtaaaggagcgtgagcgaaccttggcactggaggaggagcagaagcaggacaaagagaagccggagtaggagggagcgggtagagggatgggctctgctcagctattcttgggccagatggggcctgaccgatagaataaaagacttttctacaacaaaaaaaaaaaa

SEQ ID NO: 235 - DNA, 3669 bp, Homo sapiens
  CDS (401)..(2806)
atgactgccttcctggagatctctctcaagcagccacccatagccactactgagagagacagccaagaaagaaaagtcccagaagagaagggcagagattacaaggagggcggcagcaggaaggacaccggccagtatgaaaaggacttcctggagatggttgcttatggagtttcttacaacatgaaagctgtcatagaagataggctaaataaaaccgttgaattattttctaccgaaaagaaagataaaaatgattcagagagagaaacttccaagaaaatagaaaaggaactaaagccttatggatctagtaccatcaacatcctaaaagtgaagaataagagagagaaacaaagggagaaattgacagacgagaagaggaagaaccggaacaggcatgcagactggctcctgcggcatcacagggaccaagcagaagcccactgccagggacaaggacagccctccccgtgcactcaaagacaagtccagggatgaggacccgaggctcaggaaggccaaactgaaggagaaattcaaggacagtgcagaaaaagaaaaggacgactctgtgaagatgagcaaaggggatgataaagtatcgccatccaaagacccaggcaagaaaaatgccaggcccagggaaaagctccggggggatggcgacatgatgataatcagcttccagaggatgttctcccagaaggacctggagatcgaggagcgccacaaggggcacaaggagaggatgaagcagatggagaagctgaggcaccagtccagagaccccaacctcaaggagagggcgaagccagcagacgacgggcggaagaagggtctggaaattcctgccaagaaacctccggggctggaccctccctttaaagacaaaaagctcaaggagttgactcctattccacctgctgccgaaaataagccacgcccaggatcaggtgcagactccaaagactggctcgcagggcctcacatgaaagaggtcctacctgcatctcctaggcctgaccagagccgaccggttctccgcggcatcaagtgggcttttggaaaacgccagccaggctcctgccaagcctctctccataaacttttaccgctagagggcgtcttctcaaatttacaagcaaaaccttccccttcccccagagataagctgctggttccttccctcgaaggggccattcccccgcacctggacgccaccgaggaccagcaggctacagcccccatcatccccccggagcccagctacctggagccgctggaagaggacgccttcgccggctccgaggacgacctggacctggggtccttctcactgccggagcttcccttgcagactaaagatgtcccagatgttgaaacagaacccacagaagaaagtcttgctccttcagaaaagatccctccaggggcccctgtggtcgtaagggcctccacccagctccccacagagctcgagcctgagccctcagaggagccaaagctggacgtggctctagaagctacggaggcagaagcagtgccagaagagagggcctctggggatctggactccagcatggagcccacacccgttcgccctgaacagtgccaactgggaagcagagaccagggggccgaggctgaacacctcctaccccctgccgcatccctctgtgcccccgacaccccttgccccccatggacactgtggcacaagcccaggctgcggacagtgctggcccccacgacaacactgcgggcctcccgtgctgccgccccagccgaaggccctccctgcggcatcgacccagaagccacagaatcagaaccaaaacccacggccgaagccccgaaagcccccagagaaccggcagatgctcgtgaacgagagcaagtagggcacacctcactccaaggagtgtgcctcaggcccgcggctcggaggaggactacgcccagcccagcatccgcgcaaacgccacttccagcactccacccagcagctgaacacgtccacgcagcagacgcgggaggtgatccagcagacgctggccaccatcgtggacgccatcaagctggacgccatctacccctaccacagccgacagggccaacccctacttcgaatacctgcagatcagggaagaagatcgaggagaagcgcaagatcctgtgctgtatcacgccgcaggcgccccagtgctacgccgagtacgtcacctacacgggctcctacctcctggacggcaagccgctcagcaagctccacatccccgtgatcgcaccccctccctccctggcggagcccctgaaggagctgttcaggcagcaggaggccgtccggggaaagctgcgtctacagcacagcatcgagcgggagaagctgatcgtatcctgtgagcaggagattctgcgggttcactgccgggcggccaggaccatcgccaaccaggcagtgccattcagcgcctgcacgatgctgctggactccgaggtctacaacatgcccctggagagccagggtgacgagaacaagtcagtgcgcgaccgtttcaacgcccgccagttcatctcctggctccaggacgtggatgacaagtatgaccgcatgaagacttgcctcctcatgcggcagcagcacgaggccgcggccctgaacgccgtgcagaggatggagtggcagctgaaggtgcaggaactggaccccgccgggcacaagtccctgtgcgtgaacgaggtgccctccttctacgtgcccatggtcgacgtcaacgacgactttgtattgttgccggcatgacaccgcgggacggccgcaggacgcaggcgagggccgcacggctgcccaggactgctgctgagccccaggggcggaggagggagcgccctgtccacccgggcggggagagaccccgagagagactgcacttggccacagcgcctccatcccttccagactggtccagacgtcggggaggtgaaacacgtctcttctctaccagctgccgcggcgggggcaaagcccccagagcctcactggccccggcgggatgaggagaccatgccgggcgcgcacacacggcagcttctgtttgaaaacggcgaccttcgggcccttttctccagcaactgcagaggcatttcaggagttggagaacggagtacatttttaaaattttttgttccattctgatcaactaaagaaaattaaggtgtccacctctcacaaacagtgacctgcaggtcggaggggcaggagccccatcccagccgtggttctgttgccgccgagctgcgacggcctcagactgggcttcagacctggtgcggagccaggcggagggacacagagccaggactcccagccgtattgaaatggagtcaaatccgcgtggtttgtatcttctttcctttaatcttgggcattttgtttctctttctgagaacgtaacttgaaacactacagagccaataatcatataaaaagtgtatccgtaaacgctgtacagttttatataccttcacaatgtacttttgctgccttctagataatttattttgcaacacattactgcacagttgtaaataacttatgtactgtaacatcactttcagttatgtgtaaagaaataaataaattaattaaaatgcaaaaaaaaaaaa

SEQ ID NO: 236 - DNA, 4196 bp, Homo sapiens
  CDS (331)..(2919)
acaaagcagaatgaggagagtgatgtgatgatcgtggttgttaaggagggtggctgctgtggcccagcccagcctggctctgccctgctggctgccttggttgagagccagggactgctggccattcacagatggcgcctgggcgaggcccctggttctagtcctggtcctgaaggttcacgtctgtggcagctggcagttgctgggagttcagtgcaggctgtgaacatctgtgtcgtctctgggccacccttgcagggcaccagctgtagcctgtcattgcctctggagcccatgagaggtctggggtcctgaggctgctggcagactatgggtacaacggccagcacagcccagcagacggactcggcaggcaccccatttgagggcctacagggcagtggcacgatggacagtcggcactccgtcagcatccactccttccagagcactagcttgcataacagcaaggccaagtccatcatccccaacaaggtggcccctgttgtgatcacgtacaactgcaaggaggagttccagatccatgatgagctgctcaaggctcattacacgttgggccggctctcggacaacacccctgagcactacctggtgcaaggccgctacttcctggtgcgggatgtcactgagaagatggatgtgctgggcaccgtgggaagctgtggggcccccaacttccggcaggtgcagggtgggctcactgtgttcggcatgggacagcccagcctcttagggttcaggcgggtcctccagaaactccagaaggacggacatagggagtgtgtcatcttctgtgtgcgggaggaacctgtgcttttcctgcgtgcagatgaggactttgtgtcctacacacctcgagacaagcagaaccttcatgagaacctccagggccttggacccggggtccgggtggagagcctggagctggccatccggaaagagatccacgactttgcccagctgagcgagaacacataccatgtgtaccataacaccgaggacctgtggggggagccccatgctgtggccatccatggtgaggacgacttgcatgtgacggaggaggtgtacaagcggcccctcttcctgcagcccacctacaggtaccaccgcctgcccctgcccgagcaagggagtcccctggaggcccagttggacgcctttgtcagtgttctccgggagacccccagcctgctgcagctccgtgatgcccacgggcctcccccagccctcgtcttcagctgccagatgggcgtgggcaggaccaacctgggcatggtcctgggcaccctcatcctgcttcaccgcagtgggaccacctcccagccagaggctgcccccacgcaggccaagcccctgcctatggagcagttccaggtgatccagagctttctccgcatggtgccccagggaaggaggatggtggaagaggtggacagagccatcactgcctgtgccgagttgcatgacctgaaagaagtggtcttggaaaaccagaagaagttagaaggtatccgaccggagagcccagcccagggaagcggcagccgacacagcgtctggcagagggcgctgtggagcctggagcgatacttctacctgatcctgtttaactactaccttcatgagcagtacccgctggcctttgccctcagtttcagccgctggctgtgtgcccaccctgagctgtaccgcctgcccgtgacgctgagctcagcaggccctgtggctccgagggacctcatcgccaggggctccctacgggaggacgatctggtctccccggacgcgctcagcactgtcagagagatggatgtggccaacttccggcgggtgccccgcatgcccatctacggcacggcccagcccagcgccaaggccctggggagcatcctggcctacctgacggacgccaagaggaggctgcggaaggttgtctgggtgagccttcgggaggaggccgtgttggagtgtgacgggcacacctacagcctgcggtggcctgggccccctgtggctcctgaccagctggagaccctggaggcccagctgaaggcccatctaagcgagcctcccccaggcaaggagggccccctgacctacaggttccagacctgccttaccatgcaggaggtcttcagccagcaccgcagggcctgtcctggcctcacctaccaccgcatccccatgccggacttctgtgccccccgagaggaggactttgaccagctgctggaggccctgcgggccgccctctccaaggacccaggcactggcttcgtgttcagctgcctcagcggccagggccgtaccacaactgcgatggtggtggctgtcctggccttctggcacatccaagtacgtgtggcctctcaaggcttccccgaggtgggtgaggaggagctcgtgagtgtgcctgatgccaagttcactaagggtgaatttcaggtagtaatgaaggtggtgcagctgctacccgatgggcaccgtgtgaagaaggaggtggacgcagcgctggacactgtcagcgagaccatgacgcccatgcactaccacctgcgggagatcatcatctgcacctaccgccaggcgaaggcagcgaaagaggcgcaggaaatgcggaggctgcagctgcggagcctgcagtacttggagcgctatgtctgcctgattctcttcaacgcgtacctccacctggagaaggccgactcctggcagaggcccttcagcacctggatgcaggaggtggcatcgaaggctggcatctacgagatccttaacgagctgggcttccccgagctggagagcggggaggaccagcccttctccaggctgcgctaccggtggcaggagcagagctgcagcctcgagccctctgcccccgaggacttgctgtagggggccttactccctgtccccccacccacagggccccacgcaggcctggggtgtctgaggtgctcttggctgggagcggccctgaggggtgctggccttgaaatgattcccccacttcctggagagactgagcggagttgggagcctttttagaaagaactttttataggacagggagacagcacagccatcccttgcaaaccaccaaggtgtgtggctgacctccagggaggagcactcactggagtgctcacaaggtgcacactgctgtgtgtaccttgcagacaggccggcgttcagcctccaaggggctcactcccccagttgccaaacactgtggatctctctgtcctcttctcccctctctcagattggcctggcagcccctggcacagagcagacccggccactggtagctccccacttccttactcctgctgctctgccattgccgctccccttcttgctgcccaagcactgccctcgggcgtctggcagcctgaggtgggtggaggggacagtgttctggatagatctattatgtgaaaggcagcttcacccagttttctggactctcatgcccccatctccgacctgggagacttcaggaatgacaacctacccagcctggtggggctggcaggatggtggaggtttctcaaggagctggagacttcagggagcccctctcatggggaggaaagagcttcccagggggcgaacgcagcacagaggaagaggcctgctccacttgtctgggaacctgggcaggaggcacagaggaagccaaggcctggagctgcaggtcccccggcatctctctctgtcccggcagcccaggatggcctggtgcccccacctgctgcagcaggagccccaaggagtgctagctgagggtggttgctggggtggtcctcatggacagtgaggtgtgcaagggtgcactgagggtggtgggaggggatcacctgggttccaggccatccttgctgagcatctttgagcctgccttccggtgggagcagaaaaggccagaccctgctgagttagaggctgctgggatccactgtttccacacagcgggaaggctgctgggaacaggtggcagagaagtgccatgtttgcgttgagccttgcagctcttccagctggggactggtgcttgctgaaacccaggagctgaacagtgaggaggctgtccaccttgcttggctcactgggaccaggaaagcctgtctttggttaggctcgtgtacttctgcaggaaaaaaaaaaaa

SEQ ID NO: 237 - DNA, 1314 bp, Homo sapiens
  CDS (277)..(1314)
gcgtcgacgatttcgtctgagacggtttggcggtgagtcctgggccatgttcatctgaaaggcccgcaacccgggaaacgtcaaaacaaacagaaggacttgggattccggagcagtcgcccctatcgctgctcctgcagttgcggacgccaccgaccccgccgccggaggactgggcactgaaaggcctctaggcctaggcgcggcccgcggagccagacgtgttgctgccgtgagtaaaacgagcgccgtctccacaagagtttacaaattaaaatggaggaaatttcgttgtctggcctggatactaacaagctagaggccatcgctcaggagatttacgcggacctggtcgaggattcttgtttgggattctgctttgaggtacaccgggctgtcaagtgtggctacttcttcttggacgacacggaccctgatagcatgaaggattttgagatcgtggaccagccgggcttggacatctttggacaggttttcaaccagtggaagagcaaggagtgtgtttgccccaattgcagtcgcagcattgccgcctcccgctttgctccccatctggagaagtgcctgggaatgggtcggaacagcagccgaatcgccaaccgccggattgccaatagcaacaatatgaataagtctgagagtgaccaagaagataatgatgacatcaatgacaacgactggtcctatggctcggagaagaaagccaagaagagaaagtcagacaagaaccccaattcccctcgaagatccaagtcattaaaacacaaaaatggggaacttagcaattcggatccttttaagtataacaattcaactgggatcagctatgagaccctggggccggaggagcttcgcagcctgctaaccacgcaatgtggggtgatttctgaacacaccaagaagatgtgcacaaggtccctgcgctgcccacagcacacagatgagcagaggcgaaccgtatggatttattttctcgggccctcggctgtccttccagaggtcgagagctccctggataatgacagctttgacatgactgacagccaggccctgatcagccggcttcagtgggacggctcctctgacctctcaccctctgattcaggctcctccaagacgagtgaaaatcagggatggggtctaggtaccaacagctctgagtcacggaaaaccaaaaaaaaaaaatcccatctgagcctggtagggactgcctccggcctaggttccaacaagaagaagaagccaaagccaccggcacccccgacgcccagcatctatgatgacatcaactga

SEQ ID NO: 238 - DNA, 3224 bp, Homo sapiens
  CDS (1)..(2673)
atggaaggaggcggcaagcccaactcttcgtctaacagccgggacgatggcaacagcgtcttccccgccaaggcgtccgcgccgggcgcggggccggccgcggccgagaagcgcctgggcaccccgccggggggcggcggggccggcgcgaaggagcacggcaactccgtgtgcttcaaggtggacggcggtggcggcggtggcggcagcggcggcggcggcgaggagccggcggggggcttcgaagacgccgaggggccccggcggcagtacggcttcatgcagaggcagttcacctccatgctgcagcccggggtcaacaaattctccctccgcatgtttgggagccagaaggcggtggaaaaggagcaggaaagggttaaaactgcaggcttctggattatccacccttacagtgatttcaggttttactgggatttaataatgcttataatgatggttggaaatctagtcatcataccagttggaatcacattctttacagagcaaacaacaacaccatggattattttcaatgtggcatcagatacagttttcctattggacctgatcatgaattttaggactgggactgtcaatgaagacagttctgaaatcatcctggaccccaaagtgatcaagatgaattatttaaaaagctggtttgtggttgacttcatctcatccatcccagtggattatatctttcttattgtagaaaaaggaatggattctgaagtttacaagacagccagggcccttcgcattgtgaggtttacaaaaattctcagtctcttgcgtttattacgactttcaaggttaattagatacatacatcaatgggaagagatattccacatgacatatgatctcgccagtgcagtggtgagaatttttaatctcatcggcatgatgctgctcctgtgccactgggatggttgtcttcagttcttagtaccactactgcaggacttcccaccagattgctgggtgtctttaaatgaaatggttaatgattcttggggaaagcagtattcatacgcactcttcaaagctatgagtcacatgctgtgcattgggtatggagcccaagccccagtcagcatgtctgacctctggattaccatgctgagcatgatcgtcggggccacctgctatgccatgtttgtcggccatgccaccgctttaatccagtctctggattcttcgaggcggcagtatcaagagaagtataagcaagtggaacaatacatgtcattccataagttaccagctgatatgcgtcagaagatacatgattactatgaacacagataccaaggcaaaatctttgatgaggaaaatattctcaatgaactcaatgatcctctgagagaggagatagtcaacttcaactgtcggaaactggtggctacaatgcctttatttgctaatgcggatcctaattttgtgactgccatgctgagcaagttgagatttgaggtgtttcaacctggagattatatcatacgagaaggagccgtgggtaaaaaaatgtatttcattcaacacggtgttgctggtgtcattacaaaatccagtaaagaaatgaagctgacagatggctcttactttggagagatttgcctgctgaccaaaggacgtcgtactgccagtgttcgagctgatacatattgtcgtctttactcactttccgtggacaatttcaacgaggtcctggaggaatatccaatgatgaggagagcctttgagacagttgccattgaccgactagatcgaataggaaagaaaaattcaattcttctgcaaaagttccagaaggatctgaacactggtgttttcaacaatcaggagaacgaaatcctcaagcagattgtgaaacatgacagggagatggtgcaggcaatcgctcccatcaattatcctcaaatgacaaccctgaattccacatcgtctactacgaccccgacctcccgcatgaggacacaatctccaccggtgtacacagcgaccagcctgtctcacagcaacctgcactcccccagtcccagcacacagaccccccagccatcagccatcctgtcaccctgctcctacaccaccgcggtctgcagccctcctgtacagagccctctggccgctcgaactttccactatgcctcccccaccgcctcccagctgtcactcatgcaacagcagccgcagcagcaggtacagcagtcccagccgccgcagactcagccacagcagccgtccccgcagccacagacacctggcagctccacgccgaaaaatgaagtgcacaagagcacgcaggcgcttcacaacaccaacctgacccgggaagtcaggccattttccgcctggcagccctcgctgccccatgaggtgtccactttgatttccagacctcatcccactgtgggggagtccctggcctccatccctcaacccgtgacggcggtccccggaacgggccttcaggcagggggcaggagcactgtcccgcagcgcgtcaccctcttccgacagatgtcgtcgggagccatccccccgaaccgaggagtccctccagcaccccctccaccagcagctgctcttccaagagaatcttcctcagtcttaaacacagacccagacgcagaaaagccacgatttgcttcaaatttatgatccctgctgattgtcaaagcagaaagaaatactctcataaactgagactatactcagatcttattttattctatctcctgatagatccctctagcctactatgaagagatattttagacagctgtggcctacacgtgaaatgtaaaaatatatatacatatactataaaatatatatctaaattcccaagagagggtcaaaagacctgtttagcattcagtgttatatgtcttcctttctttaaatcattaaaggatttaaaatgtcgttgtaagattatttatttctaacctacttttacttaagtcctttgatatgtatatttctctattttatgaagagttcttggattcaatggaaacaaaactgattttaaaaaggcaactcaaatgaactagtaaatagcaccaatcaaaactttctttcattagctgtgtctctgcatctaaattgttaatcattaatggtggagaattaaataacaaatcccattttatagatctaaattgtatttcggtgctttcaatttcaaattaggttaaagaatgcac

SEQ ID NO: 239 - DNA, 2001 bp, Homo sapiens
  CDS (944)..(1561)
ctgaacgaccatttcgtgagaaggaaacccaggctcggagaaggggcggttcctgctaaagattgcacagccaatggagggcagagcagaattgggacccaaggctgggggcccccagttggaagctccctccagcaagctggccctgacacctggagccccagctgccagcctgggaggggctgggacccaatctcccccaagattaggccggggatgtctcccaccttcactctgacatcccagaccccgaccccccagccacgcaggaagggggatctgagtgtggaacacacgggtgccctcggaggtctgatgtcacccccttccccaggccttgttgctggtggcggccttggcgggcctgggcttgggcctgagcctcattttcatcgctgtctacctcatccgcttctgctgctgccggccccccgagccccccgggtccaagatcccctcgcccgggggaggctgcgtcacctggagctgcattgtcgcccttctcgccggctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtgacgactacgatgacacagacgatgacgaccctttcaaccctcaggaatccaagcgctttgtgcagtggcagtcgtctatctgagcccctcctcccggctggactggagcctggctcccctcttcgttccttccctggctgccggaggagaccccactaacccagcctgcctgggctctgaccactaacactcttggccatggacagcctgcacaggaccgcctccctgctcttggccactgtgctcccatttctgtccttggccttgggagtagctgagggggcagactagggagtagggctggcaggggagggggcagacagcctcgcctcgcacccttcatccctggctgccggtcccatccttggagggactaagctgggggtgggggacatgagtccccctgctgcccctgccacatcccagtgggctctgaccccctgatctcaactcgtggcactaacttggaaaagggttgatttaaaataaaagggaagactattttacaagcaaaaaaaaaaaa

SEQ ID NO: 240 - DNA, 1929 bp, Homo sapiens
  CDS (242)..(1039)
  misc_feature (1)...(1929): n = a,t,c or g
tttcgtgccgggaggaggagagccccagagagaggagctgggagcggaggcgcaggcaatgctcagccctggatgtagctgagaggctgggagaagagacgaccgctggagaccgagcggcgtggggaagacctaggggggtgggtgggggaagcagacaggagaacactcgaaatcaagcgctttacagattattttattttgtatagagaacacgtagcgactccgaagatcagccccaatgaacatgtcagtgttgactttacaagaatatgaattcgaaaagcagttcaacgagaatgaagccatccaatggatgcaggaaaactggaagaaatctttcctgttttctgctctgtatgctgcctttatattcggtggtcggcacctaatgaataaacgagcaaagtttgaactgaggaagccattagtgctctggtctctgacccttgcggtcttcagtatattcggtgctcttcgaactggtgcttatatggtgtacattttgatgaccaaaggcctgaagcagtcagtttgtgaccagggtttttacaatggacctgtcagcaaattctgggcttatgcatttgtgctaagcaaagcacccgaactaggagatacaatattcattattctgaggaagcagaagctgatcttcctgcactggtatcaccacatcactgtgctcctgtactcttggtactcctacaaagacatggttgccgggggaggttggttcatgactatgaactatggcgtgcacgccgtgatgtactcttactatgccttgcgggcggcaggtttccgagtctcccggaagtttgccatgttcatcaccttgtcccagatcactcagatgctgatgggctgtgtggttaactacctggtcttctgctggatgcagcatgaccagtgtcactctcactttcagaacatcttctggtcctcactcatgtacctcagctaccttgtgctcttctgccatttcttctttgaggcctacatcggcaaaatgaggaaaacaacgaaagctgaatagtgttggaactgaggaggaagccatagctcagggtcatcaagaaaaataatagacaaaagaaaatggcacaaggaatcacacgtggtgcagctaaaacaaaacaaaacatgagcaaacacaaaacccaaggcagcttagggataattaggttgatttaacccagtaagtttatgatccttttagggtgaggactcactgagtgcacctccatctccaagcactgctgctggaagaccccattccctctttatctatcaactctaggacaagggagaacaaaagcaagccagaagcagaggagactaatcaaaggcaaacaaaggctattaacacataggaaaaaatgtatttactaagtgtcacatttctctaagatgaaagatttttactctagaaactgtgcgagcacaacacacacaatcctttctaactttatggacactaaactggagccaatagaaaagacaaaaatgaaagagacacagggtgtatatctagacgataatgcttttgcaggaactaaagcatttttaagaaatgccagctgctgtaggccccatgagaaaagatgtcttaatcatccttattgaaacagatgtanaccactatatttcnacatacttcatcttcactgcatagctcaggtaggtgagtttgccaaaacccaagggggggtgattctttccccnaggttcttcctggggangattggggacagtgcaggcccgggtcccttgggggtagctccctcccaggaggtttcttgattggttgactgttatttcttctcttttggtgaggttagggggtattccttttgttcagtttcccccggtttttgaccggaggggtaatccaggtttgaaaaggttacacttacccacattagt

SEQ ID NO: 241 - DNA, 3273 bp, Homo sapiens
  CDS (388)..(2994)
gtcagattttaaaggtatcaataagctaaagtctaagaactattctagagcaagaatttctgtgagaacacaggtatagtgttgctggtctgagatatatgcatatataattttgatggttattccagtttacataccaaccagtagtgcatgagggcttctgtgttaaataactttagaagacttgttggtagttatttttgagagactaaatctcactttttatttgttttaaagtatgtaaaattttagagcctttttccatgattggttctcttcagtctaaattgttttctttgtattgtgtgaacaatctttaaatttggagaatatttaattttagagtgactttttgcctaaaatcagattaatatttgcgtgtattttatgttacaggggttagaatactgtgaagaaagatacaccctggacctgacaggtggcatgttccctttgaggggacagacgagtaataccaaattgttgggatgccagagtatagagaaatttcgatctcatggtgacagggaggaaggcgtgaatgaagctatggctgatgtccttggtgatggtggaaactcctcgctcactatctctgaaggtcctattgtctctgagcgcaggcttaaccaggaagtagcgctgaacttaaaagaagatcatgaagtagaagttggtgtactaaaagaaagtgttgacttaccagaagaaaagcttccaatttctgacagccctcctgatactcaagaaattcatgtgattgaacaagaaaagcttgaagctcaagattcaggagaagaggctaggaatctttcatttaatgagttatatccctctggaacacttaagcttcagtacaattttgatactattgaccaacagttttgtgacttagctgataacaaagacactgctgaatgtgacattgctgaagtagatggggaactttttgtggctcaaagcaactttaccttgatattggaaggtgaagaaggagaagttgagccaggtgattttgcatcatctgatgtgttacctaaagcagctaacacagcaactgaagaaaaacttgtatgcagtggggaaaatgataatcatggacaaattgcaaatttgccatctgccgtaactagtgaccaaaagtcccaaaaagtagacactttaccatatgtgcctgaacctattaaagtagcaattgcagaaaatttactagatgtaattaaagacacaagaagtaaagaaattacttcagatacaatggaacagtccattcatgaaacaatacctttagtgagccaaaacataatgtgtcccactaaattggtcaaatctgcatttaagactgctcaggaaacaagcacaatgactatgaatgtcagccaggttgatgacgtggtttcctccaaaactcgtacgagaggtcaacgtatccaaaacgtgaatgtcaaatcagcacaacaggaagcatcagcagatgttgctactcctaagatgccagggcagtcagtcaggaagaaaactaggaaggcaaaagaaatttctgaagcttctgaaaacatctattctgatgtcagaggactatctcagaaccagcaaatacctcaaaattctgttacgcctaggagaggaaggagaaagaaagaagttaatcaggacatactagaaaacaccagttctgtggaacaagaattacagatcactacaggtagggaatcaaaaagattaaaatcatctcagctgttggaaccagcagttgaagaaactactaaaaaagaagttaaggtttcatctgttacaaaaaggactcctagaagaattaaaagatctgtagaaaatcaggaaagtgttgaaattataaatgatctaaaagttagtacggtaacaagtcctagcagaatgatcagaaaattgagaagtactaatttagatgcttctgaaaatacaggaaataagcaagatgataaatccagtgacaagcagctgcgtattaaacatgttagaagggtcagagggagagaagttagtccatcagatgtgagagaagactccaaccttgagtcatctcagttgactgttcaagcagaatttgatatgtctgccatacctagaaaacgtggtagaccaagaaaaatcaatccatctgaagatgtaggatctaaggctgttaaggaagagagaagccccaagaagaaagaagctcccagcattagaaggagatctacaagaaataccccagctaaaagtgaaaatgttgatgttggaaaaccagctttaggaaaatccattttagtgccaaacgaggaactttcgatggtgatgagctctaagaaaaaacttacaaaaaagactgaaagtcaaagccaaaaacgttcattgcactcagtatcagaagaacgcacagatgaaatgacacataaagaaacaaatgagcaggaagaaagattgctcgccacagcttccttcactaaatcatcccgcagcagcaggactcggtctagcaaggccatcttgttgccggacctttctgaaccaaacaatgagcctttattttctccagcgtcagaagttccaaggaaagcaaaagctaaaaaaatagaggttcctgcacagctgaaagaattagtttcggatttatcttctcagtttgtcatctcacctcctgctttaaggagcagacaaaaaaacacatccaataagaacaagcttgaagatgaactgaaagatgatgcacaatcagtagaaactctgggaaagccaaaagcgaaacgaatcaggacgtcaaaaacaaaacaagcaagcaaaaacacagaaaaagaaagtgcttggtcacctcctcccatagaaattcggctgatttcccccttggctagcccagctgacggagtcaagagcaaaccaagaaaaactacagaagtgacaggaacaggtcttggaaggaacagaaagaaactgtcttcctatccaaagcaaattttacgcagaaaaatgctgtaatttcttgggaagattttaatgtacacctatttgtaaagtcatcagaatagtgtggattattaaatatctagtttggaagaaaataatttatataaattattgtaaatttttatgtaaacagaaggtcttcaataagtaaagtaactccatatggagtgattgtttcagtccaggcaatttttctattttatattaagacttcatacatttatatatgtaaatatggcttattaatggaatgttaaataaaatgtatacttcacagtcaaaaaaaaaaaa

SEQ ID NO: 242 - DNA, 1700 bp, Homo sapiens
  CDS (395)..(1615)
ggagcggctgccacggaaaacgcctggccggacggtggctggcggccctgcctgggcgcggagggcggcggtggcgggccccgcggccttctctcagcttcctttctcctcacgacggcctccacagtccggagcccggcggagcccggacctggcggggagagctgcctccacggccgggcacccagaccccaccgtcgcagtcgccaccacctcagtccatccttggtaccggcaatgggcttcgtatcctccagtgcacttgtaactgacttggacacggaatactaagaactcacttctgtcctcatcccagtcgcgccggcggtgaccatctcggctcttttgggcttaactgccgctcctctggactctgtctgactttgggggcaccatggaccaaagtgggatggagattcctgtgaccctcatcattaaagcaccgaatcagaaatacagtgaccagactattagctgcttcttgaactggaccgtggggaaactaaaaacgcatctatctaacgtttaccctagcaaaccattgacgaaggatcagagattggtgtattcgggcagactgcttcccgatcatctgcagctgaaagacattctcagaaaacaagatgagtatcatatggttcatctagtatgtacttctcggactcctcccagttctccaaaatccagcaccaatagagaaagtcatgaagcattgacatccagcagcaattctagttcagatcattcaggatcaacaactccatcatctggtcaagaaaccttgtctttagctgtgggttcttcctcagaaggattgaggcagcgtacccttccacaagcacaaactgaccaagcacagagtcaccagtttccatatgtaatgcaaggaaatgtagacaaccaatttcctgggcaagctgctccacctggattcccagtgtatcccgcgtttagcccactgcagatgctatggtggcaacagatgtatgctcatcagtattatatgcagtatcaagctgcagtttcagctcaggccacatcaaatgtcaacccaacccagcctactacttcacagcctctaaatttggcacatgttcctggagaagaacccccaccagctccaaacctagtggcccaagaaaatcgacccatgaatgagaatgttcaaatgaatgcacagggaggtccagtactaaatgaagaagacttcaatcgagactggctagactggatgtacacgttctcacgagctgcgattctccttagcattgtatacttctattcttcttttagtcggtttatcatggtaatgggagccatgctactggtttatttacaccaagctggatggtttccttttaggcaagaaggaggtcatcagcaggctcccaacaataatgccgaagttaacaatgatgggcaaaatgcaaacaacttggaacttgaagaaatggagcgtcttatggatgatgggcttgaagatgagagtggagaagatggaggtgaagatgccagtgcaattcaaaggcctggattaatggcttcagcttggtctttcatcaccaccttctttacttcactaataccagaggggcctccccaggttgccaattgacctgaaaaactgtgccagctacaaggagggtctgacttcaggaaagtggtttaaataacagtgcaatttcaaaaaaatttataac

SEQ ID NO: 243 - DNA, 3164 bp, Homo sapiens
  CDS (78)..(1343)
tttcgtgccgcttccggggtcgggcgcctggatagctgccggctccggcttccacttggtcggttgcgcgggagactatggcgtcctcctcggtcccaccagccacggtatcggcggcgacagcaggccccggcccaggtttcggcttcgcctccaagaccaagaagaagcatttcgtgcagcagaaggtgaaggtgttccgggcggccgacccgctggtgggtgtgttcctgtggggcgtagcccactcgatcaatgagctcagccaggtgcctcccccggtgatgctgctgccagatgactttaaggccagctccaagatcaaggtcaacaatcaccttttccacagggaaaatctgcccagtcatttcaagttcaaggagtattgtccccaggtcttcaggaacctccgtgatcgatttggcattgatgaccaagattacttggtgtcccttacccgaaacccccccagcgaaagtgaaggcagtgatggtcgcttccttatctcctacgatcggactctggtcatcaaagaagtatccagtgaggacattgctgacatgcatagcaacctctccaactatcaccagtacattgtgaagtgccatggcaacacgcttctgccccagttcctggggatgtaccgagtcagtgtggacaacgaagacagctacatgcttgtgatgcgcaatatgtttagccaccgtcttcctgtgcacaggaagtatgacctcaagggttccctagtgtcccgggaagccagcgataaggaaaaggttaaagaattgcccacccttaaggatatggactttctcaacaagaaccagaaagtatatattggtgaagaggagaagaaaatatttctggagaagctgaagagagatgtggagtttctagtgcagctgaagatcatggactacagccttctgctaggcatccacgacatcattcggggctctgaaccagaggaggaagcgcccgtgcgggaggatgagtcagaggtggatggggactgcagcctgactggacctcctgctctggtgggctcctatggcacctccccagagggtatcggaggctacatccattcccatcggcccctgggcccaggagagtttgagtccttcattgatgtctatgccatccggagtgctgaaggagccccccagaaggaggtctacttcatgggcctcattgatatccttacacagtatgatgccaagaagaaagcagctcatgcagccaaaactgtcaagcatggggctggggcagagatctctactgtccatccggagcagtatgctaagcgattcctggattttattaccaacatctttgcctaagagactgcctggttctctctgatgttcaaggtggtggggttctgagacacttgggggaattgtggggatattctagccaccagttctcttcttcctttgctaaattcaggctgcaggctccttccatccagataactccatcctgtcgagtaggctctttctgaccctcagaaatacattgtcctttttcctctttgcccatttttcttccctctcttcctccccatgagaagtctgcttgtagtattagaatgttattgttgactctctcccaagtgccttgatctttgtaatatctcctgttgtttctatgatataggagctaggggaagggggttgtttgccttcttcaggacctgactggacagatggacctggctcaagcaactactctggatgcactttgctgtgtgggatgaactaaaagtgtctgaattttgctgataactttataaaactcactatggcatgcttccctcctggtgggccctaggatggatgacactcaagatactacagatgtgggtgcaggcatgcacacacacgatggaatatggccattcctacacaggtggggtagagagtgggtcagcagcctggcacctcacagaggtgggacctaagaggactcatgattatgcagagaattggattgggtctctgtcatagattgagtaatctcttcccttacctcaattccatctccacccatctctacatctgggcacagcaacccagagatggccaaaagcattcaagcctgggggaagatgtttgactattgctgctcttcaccagaacctcacacctctcctgggactggaacccttcagtgggtgtgtggccagttttggaggctggaatgatgggccagggtgtaggattcattctccatgtaaagtttcctttcatcctgcctagccatccccaaggtttatttccagaagaaaggaatatctctacttggatcaattctggtcatttcaagaggatggaggcctcaagtgtgggaacttcccctactccctggatgtgtgtacctagcacacttccttctcccacccctttttccagttggatttgtttttctgttctcttctgtcctgtcttatactgcaactgtgtctcctaggggacagatggccttctttgtcatcttcactctccacccccagagaggagtcagagccataactcaatcactcagcccctccaaagatagttgatgtgtgataatctcataatgttgagaaccctgatgagatacattgtcttcctctccctacaatgcctctggggccaaggcacccattcttcttgctatcctccatcccccttgaggcttccactttttttttttttagacataaagctgggcatcagcaactggcctgtggtgatgcaaagctgctttgctctgtatctggctggactgatctgtctcacaagaagccatgaggccatagggagaagctccctctccccttcatcttctgctccaaaggtggtagcaagaggagtacccagttaggggttggagcccccatataacatcttcctgtcagaagactgatggatctttttcattccaaccatctccctttcccccgatgaatgcaataaaactctgtgacaccagcaaccattgctctttagaaatgggttttctgatcatatggctgatgtgttatgggcagtatggatgtcttcatttgttgcttctgtttttcatcttttttgttttattaataaaaatttatgtatttgctcctgttactataataatacagggaataaattattcaatccaaaaaaaaaaaa

SEQ ID NO: 244 - DNA, 6423 bp, Homo sapiens
  CDS (59)..(6172)
  misc_feature (1)...(6423): n = a,t,c or g
cagggggcggtaagtggcggtcgttcgcggaagtagggctgatgagagtgtgtgttgaatgcgcgagcggatggacgcagataggggcgcaagcagctatattgagtacactgtggtgaaccctgtgggaagcaagttcagtattgggaccattgatggtgaagtgaggctcgctggagaactggacagagaagaagtttctaattatactctaacagtggtggctacagacaaaggtcaaccatctctctcttcatctacagaggttgtagttatggtacttgacatcaatgataacaaccccatctttgcacaagctttgtataaagtggagattaatgaaaacacacttactggaacagatataatacaagtgttcgcagcagatggagatgaaggcacaaatggacaggttcgctatggcattgttaatggtaataccaatcaggaatttcggatagactctgtcacaggtgccatcactgtcgctaaacctttggatagagaaaagacccctacctaccatttaactgttcaggcaacagatcgaggcagcacacccagaactgatacctccacggtcagcattgttctactggatattaatgactttgttcctgtatttgagctatctccatattctgtaaatgtccctgagaatttagggacactacccagaacaattcttcaggtggtggcaagagatgatgatcgaggatctaacagcaaactctcatatgttctgtttggtggtaatgaagacaatgcttttactctctcagccagtggagaacttggagtaacacagagtctggatcgggaaacaaaagagcgctttgtcttaatgattacagctacagattcagcttttgggaaagaaattcgattctcccggttccccaccaccccttccccggtgcgcagttgtgcttggacgtttgttcctccctcttcacgttcttcgctgcggggagccaggaccatggacttagcaccagacagggctactggccgcccgtggctcccgttgcacactctatcagtatctcagctccttcgagtgttttggctactgtcattgcttccggggcaggcctgggtccacggggccgagccgcgccaggtgttccaagtgctggaagagcaacctccaggcactctggtaggcaccatccagacgcgccccggcttcacctacaggctcagcgaaagccacgccctgtttgccataaacagtagcaccggagccctgtacaccacctccaccatcgaccgcgagagcctgcccagcgacgtgatcaacctggtggtcctttccagcgcgcccacctaccccaccgaagtgcgagtgctggtgcgggacctcaatgacaacgcccccgttttcccggacccctctatcgtggtcactttcaaggaagacagtagcagcggacgccaagtcatcttagacaccgccaccgactcggacatcggctcaaacggtgtggaccaccgctcctaccgcatcatccgcggcaatgaggcggggcgcttccgtctggacatcaccctgaacccgagcggcgagggagcgttcctgcatctggtgtccaagggcggactggaccgtgaggtcactccgcagtaccagctcctggttgaggtggaggacaagggtgagcctaagcggcggggctaccttcaggtaaacgtgactgtgcaagacattaatgacaaccccccggtttttggcagttctcactaccaggcgggggtgcctgaggacgcggttgtgggttccagcgtcctccaggtggcggcggcggacgcggacgagggcaccaacgcggacatccgctatcgcctgcaggacgaggggacccccttccaaatggaccctgagacgggacttatcacggtgcgggagcccctggacttcgaagctcggcgccaatactcgcttacggtgcaggcgatggacagaggcgtgccttccctcactgggcgcgccgaggcgctgattcagctgctggacgtgaatgacaatgacccggtagtgaagttccgctacttcccggccacctcgcgctacgcctcggtagatgagaatgctcaagtgggcaccgtggtggctctgctcaccgtgacggacgcagattctcccgcggccaacgggaacatctccgtgcaaattctcgggggcaatgagcagcgccactttgaagtgcaaagcagcaaagtgccgaacctgagcctaatcaaggtggccagcgccttggaccgcgagcgcatcccttcctacaacctcacagtttccgtctctgataactacggggcgccccctggcgcagcagtcctggcgcgctcttctgtggcaagcctggtgatttttgttaatgacatcaatgaccatcctcctgtcttttcacagcaagtgtacagagtgaacctgagcgaggaggcgcctccgggaagctatgtgagtgggatatctgccactgatggcgactctggtctcaatgctaatctgcgttacagcattgtctctggcaatggactgggatggttccatatcagtgaacatagcggcctcgtgaccactgggtcctctgggggcctggaccgtgaacttgcttcccagattgttctgaatataagtgcccgggaccagggagttcaccccaaggtgtcctatgcccagcttgtagtaactctcctagatgtgaatgatgaaaagccagtatttagccagccagaagggtatgatgtgtctgtggttgagaatgccccaacagggacagaactgttgatgctcagggcaactgacggggacctgggtgacaacggaacagtgcgcttctccttacaagaggcagagactgaccggaggtccttccgtctggatcctgtgtctgggaggttgagtactatttcctccttggacagagaagagcaagccttctactccctgttggttctggccacagatctgggctcccctccccagtcatcaatggctcgcataaatgtgagtcttctggatataaatgataacagccctgtcttctacccggtccaatactttgctcacattaaggagaatgagcctggaggtagctacatcaccactgtgtctgccactgacccagacttgggtaccaatggtactgtcaaatatagcatatctgctggggacaggtctcggtttcaggtcaatgctcagagtggggttatttctacaagaatggccctagacagagaagaaaaaacagcttatcagttgcaaatagtagctactgatggtggcaatttacaatctcccaaccaggcaatagtaaccatcactgtattggacactcaagacaacccacctgtattcagtcaggttgcctacagctttgtggtttttgagaacgtggcgctgggatatcatgtgggtagtgtgtctgcatccaccatggatctcaattccaacatcagttatctcattactactggggatcagaaaggtatgtttgctatcaaccaggtcactgggcagcttaccacagcaaatgtgattgatagagaagagcaatccttttatcagctgaaggtagtggccagtgggggcacagtgactggagacactatggttaacataacagttaaggatttgaatgacaactctccccatttccttcaggcaatagagagtgtaaatgtggtggagaattggcaggcaggtcacagcattttccaggccaaagctgtggaccctgatgaaggtgtcaatggcatggtactctatagtctgaagcaaaaccccaagaacctgtttgctatcaatgaaaagaatggcactattagtctgcttgggcccctggatgttcatgctggctcctaccaaatagagatcttggcatctgacatgggtgtcccacagctctcctctagtgtcatcttaacagtttatgtccatgatgtaaatgacaattcaccagtgtttgaccaactctcttatgaagtcaccctttctgagtcagaacctgtgaattctcgattctttaaagtacaagcttctgataaggattcaggagcaaatgatggtcaattgtatataaaaagtgaactggaccgtgaacttcaagacagatatgttttaatggttgttgcttctgacagagcagtggaaccccttagtgctactgtgaatgttactgtaattttagaagatgtaaatgataacagacctctttttaacagtaccaattacacattttacttcgaagaagagcagagggctgggtcgtttgtgggcgaagtaagtgctgtagataaagactttgggccaaatggagaagtaaggtattcttttgaaatggtgcagccagattttgagttgcatgccatcagtggggaaattacaaatactcatcagtttgacagggagtctcttatgaggcggagagggactgctgtgtttagctttacagtcatagcaacagatcaggggatccctcagcctctcaaggatcaggccactgtacatgtttacatgaaggatataaatgataatgctcccaaatttttaaaagacttttaccaagctacaatatcagaatcagcagccaatctgacacaagtgttaagagtatctgcctcagatgttgatgaaggtaataatggacttattcactattctataataaaaggaaatgaagaaagacagtttgctatagacagtacctctggtcaggtaacactaattggcaaattagactatgaagcaacacctgcctattcccttgtaattcaagcagtggattcagggacaatccccctcaattcaacgtgtactttaaatattgatattttagatgaaaatgacaataccccttctttccctaaatcaacactctttgttgatgttttggaaaacatgagaattggtgaactcgtgtcctctgttactgcaactgattccgattcaggtgacaatgctgatttatattacagtattactgggactaacaaccacggaacttttagcattagcccaaacactgggagtatttttcttgccaaaaaactggactttgaaacacagtctttgtataaattaaatataacagcaaaagaccaaggaagacctcctcgttcatctacaatgtcagtggttattcacgtgagggactttaatgacaatcctcctagctttcctcctggagatattttcaagtctattgttgagaacattcccattggtacatctgtcatttcagtgactgcacatgaccctgatgcagacattaatggtcaactatcctacacaatcattcaacagatgccaagaggcaaccactttaccatagatgaagtcaaagggactatatatactaatgctgaaatagatcgggaatttgctaatctctttgagttgactgtaaaagccaatgatcaagctgtgccaatagaaactagacggtatgctttgaagaacgtgaccattttggttacagacctcaatgacaatgtcccaatgtttatatcacaaaacgcccttgctgcagacccatcagctgtgattggttccgttctgacaacaattatggctgctgacccagatgaaggtgctaatggagaaatagagtatgagatcatcaatggggacacagacaccttcattgttgatcgttatagtggagacctgagagtggcttcagcgttggtgccttcacagttgatctacaatctcatagtttcagcaacagaccttgggcctgaaaggaggaaatcgaccactgaattgaccatcattcttcagggccttgatggacctgtttttactcaacccaaatatataactattttgaaggaaggagaacccattggcacaaacgtgatatcaatagaagcagctagccccagaggatctgaggccccagtggagtattatattgtttcagttcgttgtgaagaaaaaactgttggacgcctctttactattggacgacatactggtataattcagaccgcagccattctggaccgggagcaaggagcatgtctttacctggtggatgtttatgccatagaaaaatcaactgcttttcccagaacacagagagcagaggcccctcaaagacattctagtgtcagtcagccaaaaacacaaacatcaaatgtggtttgtgatacttggcagtgacccagacacaacatgcaagtnaaattnaggctcatgtgcttgttttcttgcttctttncttttttggggggaggaggtggggattttntttatttnaaatgataatttattattatnattatatattttngtatcctctgtgattttttttcataatagttggttatgtctatctatggntggggaagatatttatggcttaaagggccatgattaattagaggtataattctaaggggaatccaattttt

SEQ ID NO: 245 - DNA, 1034 bp, Homo sapiens
  CDS (310)..(846)
  misc_feature (1)...(1034): n = a,t,c or g
atgctctccccggagagtgagcaaaagaaggcaagatgcccaacagtaatacaggttgttctcttagggaggttttcgaggaaaagcgcttttctgcgctgcctaggagacctgcgtaccctcccgaagccgaacagttgctcggagcagtcggcttggcgccgcgagcgccgggtgcccctcttcggcctcccgggtttctcggaaagaaaactcaggtatctcttagctaaacaagcctttgcagattgtggagacttgaattatctgagaagagctaatctgggcctctgcctgcacagctcttgaatggtgtggactgtcccgaggaaatccaaggttcccgtgtcagtggctatgatgacacctcaagttatcactccccagcaaatgcagcagatcctccagcaacaagtgctgagccctcagcagctccaggttctcctccagcagcagcaggccctcatgcttcaacagcagcttcaagagttttataaaaaacaacaggaacagttgcagcttcaacttttacaacaacaacatgctggaaaacagcctaaagagcaacagcaggtggctacccagcagttggcttttcagcagcagcttttacagatgcagcagttacagcagcagcacctcctgtctttgcagcgccaaggccttctgacaattcagcccgggcagcctgcccttccccttcaacctcttgctcaaggcatgattccaacagaactgcagcagctctggaaagaagtgacaagtgctcatactgcagaagaaaccacaggcaacaatcacagcagtttggatctgaccacgacatgtgtctcctcctcaaactagaagcttctccaagcatgatggccacaagncagtcctctttctgtgcctggcatatctggtacttaaagaggactgacctgtgggtcgacgcggccgcgagcctggaatcgttaacataaacagaacaaactcattcttgagtctcgatagaatgattttacttcttctaattaactgaatttagcagg

SEQ ID NO: 246 - DNA, 1907 bp, Homo sapiens
  CDS (208)..(1695)
gcacgagacaaactccgagcatgctgcatcagtaccggcggacacagccagtgttctgaaagtctccctgttcgcacactaagcattgcaccaggtcaatgtcgaccaccgagggttttgggtagaccaaagcacaaagaagtccacttagagtgggatgttcctgcatcggaaagtggctgtgaggtctcagagtacagcgtggagatgacggagcccgaagacgtagcctcggaagtgtaccatggcccagagctggagtgcaccgtcggcaacctgcttcctggaaccgtgtatcgcttccgggtgagggctctgaatgatggagggtatggtccctattctgatgtctcagaaattaccactgctgcagggcctcctggacaatgcaaagcaccttgtatttcttgtacacctgatggatgtgtcttagtgggttgggagagtcctgatagttctggtgctgacatctcagagtacaggttggaatggggagaagatgaagaatccttagaactcatttatcatgggacagacacccgttttgaaataagagacctgttgcctgctgcacagtattgctgtagactacaggccttcaatcaagcaggggcagggccgtacagtgaacttgtcctttgccagacgccagcgtctgcccctgaccccgtctccactctctgtgtcctggaggaggagccccttgatgcctaccctgattcaccttctgcgtgccttgtactgaactgggaagagccgtgcaataacggatctgaaatccttgcttacaccattgatctaggagacactagcattaccgtgggcaacaccaccatgcatgttatgaaagatctccttccagaaaccacctaccggatcagaattcaggctataaatgaaattggagctggaccatttagtcagttcattaaagcaaaaactcggccattaccacccttgcctcctaggctagaatgtgctgctgctggtcctcagagcctgaagctaaaatggggagacagtaactccaagacacatgctgctgaggacattgtgtacacactacagctggaggacagaaacaagaggtttatttcaatctacagaggacccagccacacctacaaggtccagagactgacggaattcacatgctactccttcagaatccaggcagcaagcgaggctggagaagggcccttctcagaaacctataccttcagcacaaccaaaagtgtcccccccaccatcaaagcacctcgagtaacacagttagaaggaaattcatgtgaaattttatgggagacggtaccatcaatgaaaggtgaccctgttaactacattctgcaggtattggttggaagagaatctgagtacaaacaggtgtacaagggagaagaagccacattccaaatctcaggcctccagaccaacacagactacaggttccgcgtatgtgcgtgtcgtcgctgtttagacacctctcaggagctaagcggagccttcagcccctctgcggcttttgtattacaacgaagtgaggtcatgcttacaggggacatggggagcttagatgatcccaaaatgaagagcatgatgcctactgatgaacagtttgcagccatcattgtgcttggctttgcaactttgtccattttatttgcctttatattacagtacttcttaatgaagtaaacccaacaaaactagaggtatgaattaatgctacacattttaatacacacatttattcagatactcccctttttaaagcccttttgttttttgatttatatactctgttttacagatttagctagaaaaaaaatgtcagtgttttggtgcacctttttgaaatgcaaaactaggaaaaggttaaactggattttttttttaaaaaaaaaaaa

SEQ ID NO: 247 - DNA, 1889 bp, Homo sapiens
  CDS (47)..(1111)
ctggtcggcggacgtgctgccgagtagtcccggaagcgaagcagcgatggcggagagtccgactgaggaggcggcaacggcgggcgccggggcggcgggccccggggcgagcagcgttgctggtgttgttggcgttagcggcagcggcggcgggttcgggccgcctttcctgccggatgtgtgggcggcggcggcggcagcgggcggggccgggggcccggggagcggcctggctccgctgcccgggctcccgccctcagccgctgcccacggggccgcgctgcttagccactgggaccccacgctcagctccgactgggacggcgagcgcaccgcgccgcagtgtctactccggatcaagcgggatatcatgtccatttataaggagcctcctccaggaatgttcgttgtacctgatactgttgacatgactaagattcatgcattgatcacaggcccatttgacactccttatgaagggggtttcttcctgttcgtgtttcggtgtccgcccgactatcccatccacccacctcgggtcaaactgatgacaacgggcaataacacagtgaggtttaaccccaacttctaccgcaatgggaaagtctgcttgagtattctaggtacatggactggacctgcctggagcccagcccagagcatctcctcagtgctcatctctatccagtccctgatgactgagaacccctatcacaatgagcccggctttgaacaggagagacatccaggagacagcaaaaactataatgaatgtatccggcacgagaccatcagagttgcagtctgtgacatgatggaaggaaagtgtccctgtcctgaacccctacgaggggtgatggagaagtcctttctggagtattacgacttctatgaggtggcctgcaaagatcgcctgcaccttcaaggccaaactatgcaggacccttttggagagaagcggggccactttgactaccagtccctcttgatgcgcctgggactgatacgtcagaaagtgctggagaggctccataatgagaatgcagaaatggactctgatagcagttcatctgggacagagacagaccttcatgggagcctgagggtttagaccctgctcccatctccccttcccccactcaagagtcccagcagaatcccttccccccaccccagggatggagaggcactgtgtatctccctccagactcgaagtcatcctgcaaggatggcaagaaccaagcaagctccgatcccagggtgtgggagtggggggcctgttcccggtctgacctccttggcactggagccatctggcggcttcgttcatccattcatcccgtatcaggggccaaggtacctttacaggagcacctagagcgagggccttgtggccacaccacaacaacaacacaacacacctctccacagggccagctccttcaggataacgtggcacgatggcaattgcaatcccagagggagtgtgcgcaactgatccaccgcgaactcctggcagcacttccggtgggcgctcgccaggggaacactatgcagctcgcaggcgagcacacatgccagagtaacgcctcaggaagcagggctccatcggcacctcgcatcctggcttacttccacaataccctcctcaaggccacacacagtcggtcgactactagcatccacgcgcctaaaacacacgagagaacgtgcggatacgggtgcgatacaacgaaacatagacgccaaatatagccaccgagcgaaccgacagtatagagcgacgtacgataaaagattgaggcagcagctcaacaggcgccgcagtacaccacgacgtatgtacgaacgtcagaaacaatggagactcagcacaaccacaacacctt

SEQ ID NO: 248 - DNA, 1847 bp, Homo sapiens
  CDS (5)..(1759)
cgccatggcggcggcagcggtgtcagagtcttggccggagctggagctggctgagcgcgagcggcggcgggagctgctgctgacggggcccgggctggaggagcgagtgcgggcggcgggtgggcagctgccgccgcggcttttcaccctgccgctgctgcactacttggaagtgagcggctgcgggagcttgcgcgcgccggggcctggcctggcgcagggcctgccgcagctgcacagcctcgtgctgcggcgcaacgcgctggggcccggcctgagccccgagctcgggccgctgcctgcccttcgggtgctcgacctgtcgggcaacgcgcctggaggcgctgccgccgggccaaggcctgggccccgccgagccgccgggccttccgcagctgcagagcctcaacctcagcggcaaccggctgcgcggagctggccagccgacctggcgcgctgcgccccgcgcctgcagagcctcaacctcaccggcaattgcctagactcctttcccgccgagctctttcgccccggcgcgctgcccctgctcagtgaactggcggctgctgacaactgcctccgagaactcagccccgacatcgcccacctggcctcgctcaagacgttggacctctcgaacaaccagctgagcgagatccctgcagagcttgcggactgccccaagctcaaggagatcaatttccgtgggaacaagctgagggacaagcgcctggagaagatggtcagcggctgccagaccagatccatcctggagtacctgcgcgtcggaggccgtggtggcgggaagggcaagggccgtgccgagggctcggagaaggaagagagccggaggaagaggagggagaggaagcagaggcgggaaggtggtgatggggaggagcaggacgtgggagatgccggccggctgctgctcagggtcctgcacgtctctgaaaaccccgtacctctgacagtcagagtgagccccgaggtccgggatgtgcggccctacattgtgggggccgtggtgcgaggcatggacctgcagccagggaatgcactcaagcgcttcctcacctcgcagaccaagctccacgaagatctctgtgagaagaggacggctgccacccttgccacccacgagctccgtgccgtcaaagggcccctgctgtactgcgcccggcccccacaggacctcaagattgtccccttggggcggaaagaagccaaggccaaggagctggtgcggcagctgcagctggaggccgaggagcagaggaagcagaagaagcggcagagtgtgtcgggcctgcacagataccttcacttgctggatggaaatgaaaattacccgtgtcttgtggatgcagacggtgatgtgatttccttcccaccaataaccaacagtgagaagacaaaggttaagaaaacgacttctgatttgtttttggaagtaacaagtgccaccagtctgcagatttgcaaggatgtcatggatgccctcattctgaaaatggcagaaatgaaaaagtacactttagaaaataaagaggaaggatcactctcagatactgaagccgatgcagtctctggacaacttccagatcccacaacgaatcccagtgctggaaaggacgggccctcccttctggtggtggagcaggtccgggtggtggatctggaagggagcctgaaggtggtgtacccgtccaaggccgacctggccactgcccctccccacgtgactgtcgtgcgctgacgccagggccgcctgtccgcgtttgtttggccggtttgcggaggtttctatgcggcaatgctgaattatccgttagattttcacccca

SEQ ID NO: 249 - DNA, 1287 bp, Homo sapiens
  CDS (160)..(1044)
aatagcttattggaaacttttacgggtcatgtgacttgtcacactgactccttgaggtgggtttaccaatctcctatagatggggaaaccgaggcacaagagctaagttactcatctaagggaaagaaccatgatccagtcccaggcctgtgtgactacatggtcttttacaaaatatttgcccatcagagacaaaatactggtctagctagaactcaggttgatgcagcaggacaactgggaaattactgtgtactgcagcttgaagaaaaagggcatctctggctgaaatcaatcaccctcagcctgggagctcagccttctgctggaagaatctgccttggaggagaaagccatagggctgacagcggtgctctgccatttcctcccccacgcagtgggtgctgctggcctgtggagacctgtgctgccagccacgccccatgcctcctgattgtgctttgcctctcgctgccatacaagtcagggctggcacctcattttccgctgcagagacaaggcattgcctcctggaggccagagggaggacaggaggaaatccagggaagcagaccctttcagtgtctgcctgctccttgccatccaccacaaaccctcaccgaaccagtggccaccaccatgacaagggaccagaatggaacctgggagatggagagtaatgaaaactttgagggctacatgaaggccctggatattgattttgccacccgcaagattgcagtacgtctcactcagacgaaggttattgatcaagatggtgataacttcaagacaaaaaccactagcacattccgcaactatgatgtggatttcactgttggagtagagtttgacgagtacacaaagagcctggataaccggcatgttaaggcactggtcacctgggaaggtgatgtccttgtgtgtgtgcaaaagggggagaaggagaaccgcggctggaagcagtggattgagggggacaagctgtacctggagctgacctgtggtgaccaggtgtgccgtcaagtgttcaaaaagaaatgatggcgacgtgggaggcctgccaagcacaagctccccactgcccacactgagtggtctactggctttgagaaacagctgtggggaccttcccactcttgacagagccccattaaggcatctgggtgggttttaaacagaatgcctatgtagcagtgatagacatattcccctcctttgaaacctagcattaaatggaaaaacaaaaattactcccatattttgaaaccctttaaaaaaaaaaaa

SEQ ID NO: 250 - DNA, 500 bp, Homo sapiens
  CDS (42)..(416)
aacagaagacttggcatcgagggtcaggaccacagcctgacatggcagggagagataatgatcagcagattggtctaaatgtctccaaagtctcgtccaagtctgctaccttgacattctatgaatcggaaggctggaatactggccagtgggctgtgctaaagtttgctgtttccactggggccactcttattgctgggcacttcactcctggaactttcactaatcagatccaggcagccttccaggagccacggcttcttgtggttactgaccccaggctgaccaccagcctctcacggaggcatcttatgttaacctacctaccatgcgctgtgcaacacagatctcttatctgcgctatgtggacattgccatcccatgcatcaacacgggagctcactcagtgggtttgatgtggtggatgctggctcgggaagttctgcgcatgcgtggcaccatttcccgtgaacacccatgggagtcatgctgatggtacc

SEQ ID NO: 251 - DNA, 2709 bp, Homo sapiens
  CDS (746)..(1663)
tgctctggtccccaggagaggaagtgtctctgatgagggacctgcctgtgggaagatcatggagctgtctttgatcttcggagaagtctgtcccaccactgcagtgaccacagttgtgttgggctcacaccagtgaaccgaagctctggattctgagagtctgaggattccgtgaagatctcagacttgggctcagagcaaggatgcgtgaaattgtccatattcagattggccagtgtggcaaccagatcggagccaagttctgggagatgattggtgaggaacacgggatcgacttggctgggagcgaccgcggggcctcggccttgcagctggagagaatcagcgtgtactacaacgaagcctacggtaggaaatatgtgccccgagcagtcttggtggacctagaacctgggacgatggacagcattcgatctagcaaattaggagctctctttcaacccgacagttttgtccatggtatgtttttccagaaggttccaccaggaggagggggggatgctttactggtgcccttctcttttcacctttcttcccctgctggtttctctttttggccacaggtaactctggggctggcaacaactgggccaaaggccactacacggagggagccgagctgatcgagaatgtcctagaggtggtgaggcacgagagtgagagctgtgactgcctgcagggcttccagatcgtccactccctgggcgggggcacaggctccgggatgggcactctgctcatgaacaagattagagaggagtacccggaccggatcatgaattccttcagcgtcatgccttctcccaaggtgtcggacacggtggtggagccctacaacgcggttctgtctatccaccagctgattgagaatgcagatgcctgtttctgcattgacaatgaggccctctatgacatctgcttccgtaccctgaagctgacgacacccacctatggggatctcaaccacctagtgtccttgaccatgagcggcataaccacctccctccggttcccgggtcagctcaacgcagacctgcgcaagctggcggtgaacatggtccccttcccccgcctgcacttctttatgcccggctttgccccactcacggcccagggcagccagcagtaccgagccctctccgtggccgagctcacccagcagatgttcgatgcccgcaataccatggctgcctgtgacctccgccgtggccgctacctcacagtggcctgcattttccggggcaagatgtccaccaaggaagtggaccagcaactgctctccgtgcagaccaggaacagcagctgctttgtggagtggattcccaacaacgtcaaggtggctgtctgcgacatcccgccccgggggctgagcatggccgccaccttcattggcaacaacacggccatccaagagatctttaatagggtctctgagcatttctcagccatgttcaaaaggaaagcttttgtgcactggtacaccagcgaagggatggacataaacgaatttggggaagctgaaaataacatccatgatttggtatccgagtaccaacaatttcaagatgccaaagcagttctagaggaagatgaagaggtcacggaggaggcagaaatggagccagaagataagggacattaactgtgagagaagctgtgccgcggagtcgcttacagaacagtttctcattagatgagtgtttctcctgcagcactccaaaacccactctgcactgcagcacagtgaatgatatgcactcaccattagcttcgacacagggactgagggagacaggtggggagcagctgacaggcattagggtctttgctgacatctactaaccttgaagagtttgatgttcagtgcatacttattaacttaaaaaaatagcaaatttattgtaaagtgctccctttgtttcaaagtgtttgccaggcatccagactacacgtgtggatttgcagggagccactggagttggtgttacatttttatactttagcagcactgataggcaccctggaatcctcacttggtatccgagggctactaagactctttccttaggttctttcctctgagcaaacactgactggcatcctgctttccagtgcctgccagcctccagaagagccaggtgcctgactagtacatggggagctacagagccaaggtcaatgtgagtcaacatccactagaaatatccatgttgtgtagacctgtgcatacaacatgctaactggaaaagaggaaaaaagaaaagccacagtcctctccacaaaaatacctggtccaaacaagaaaaacaaaaagacaagcaaaactaaagaactgcagtcttctgatctttatttctgaagagctagcctttaacatacatgtttatatagtttaaatttcttactactgttagatcccaggaattcattaataatcatccttggctttccttttaaaggctattttgaaatggtcttttcactttcattcagtcatcaccccccaaaatgctctgcagcctctctgctctttgagaaaggggcacaccatgcgctcggcaaccattcaaatgcagggaattaaggcagcaatggctccaggtgtccttctcagttatggaggacatcgtctccatagggaacttttacagttcaaattaatttgcagaagttgccataaatgtttgg

SEQ ID NO: 252 - DNA, 2295 bp, Homo sapiens
  CDS (110)..(1249)
ttaaaacattaacttttagaaaaacaagtaggctgactttttcctatttttctacacaggtaggaaatatgtgccccgagcagtcttggtggacctagaacctgggacgatggacagcattcgatctagcaaattaggagctctctttcaacccgacagttttgtccatggtaactctggggctggcaacaactgggccaaaggccactacacggagggagccgagctgatcgagaatgtcctagaggtggtgaggcacgagagtgagagctgtgactgcctgcagggcttccagatcgtccactccctgggcgggggcacaggctccgggatgggcactctgctcatgaacaagattagagaggagtacccggaccggatcatgaattccttcagcgtcatgccttctcccaaggtgtcggacacggtggtggagccctacaacgcggttctgtctatccaccagctgattgagaatgcagatgcctgtttctgcattgacaatgaggccctctatgacatctgcttccgtaccctgaagctgacgacacccacctatggggatctcaaccacctagtgtccttgaccatgagcggcataaccacctccctccggttcccgggtcagctcaacgcagacctgcgcaagctggcggtgaacatggtccccttcccccgcctgcacttctttatgcccggctttgccccactcacggcccagggcagccagcagtaccgagccctctccgtggccgagctcacccagcagatgttcgatgcccgcaataccatggctgcctgtgacctccgccgtggccgctacctcacagtggcctgcattttccggggcaagatgtccaccaaggaagtggaccagcaactgctctccgtgcagaccaggaacagcagctgctttgtggagtggattcccaacaacgtcaaggtggctgtctgcgacatcccgccccgggggctgagcatggccgccaccttcattggcaacaacacggccatccaagagatctttaatagggtctctgagcatttctcagccatgttcaaaaggaaagcttttgtgcactggtacaccagcgaagggatggacataaacgaatttggggaagctgaaaataacatccatgatttggtatccgagtaccaacaatttcaagatgccaaagcagttctagaggaagatgaagaggtcacggaggaggcagaaatggagccagaagataagggacattaactgtgagagaagctgtgccgcggagtcgcttacagaacagtttctcattagatgagtgtttctcctgcagcactccaaaacccactctgcactgcagcacagtgaatgatatgcactcaccattagcttcgacacagggactgagggagacaggtggggagcagctgacaggcattagggtctttgctgacatctactaaccttgaagagtttgatgttcagtgcatacttattaacttaaaaaaatagcaaatttattgtaaagtgctccctttgtttcaaagtgtttgccaggcatccagactacacgtgtggatttgcagggagccactggagttggtgttacatttttatactttagcagcactgataggcaccctggaatcctcacttggtatccgagggctactaagactctttccttaggttctttcctctgagcaaacactgactggcatcctgctttccagtgcctgccagcctccagaagagccaggtgcctgactagtacatggggagctacagagccaaggtcaatgtgagtcaacatccactagaaatatccatgttgtgtagacctgtgcatacaacatgctaactggaaaagaggaaaaaagaaaagccacagtcctctccacaaaaatacctggtccaaacaagaaaaacaaaaagacaagcaaaactaaagaactgcagtcttctgatctttatttctgaagagctagcctttaacatacatgtttatatagtttaaatttcttactactgttagatcccaggaattcattaataatcatccttggctttccttttaaaggctattttgaaatggtcttttcactttcattcagtcatcaccccccaaaatgctctgcagcctctctgctctttgagaaaggggcacaccatgcgctcggcaaccattcaaatgcagggaattaaggcagcaatggctccaggtgtccttctcagttatggaggacatcgtctccatagggaacttttacagttcaaattaatttgcagaagttgccataaatgtttgg

SEQ ID NO: 253 - DNA, 1529 bp, Homo sapiens
  CDS (93)..(1529)
aaggatccttaattaaattaatcccccccccccccgccagtcagtccggaggctgcggctgcagaagtaccgcctgcggagtaactgcaaagatgctgtccgtgcgcgttgctgcggccgtggtccgcgcccttcctcggcgggccggactggtctccagaaatgctttgggttcatctttcattgctgcaaggaacttccatgcctctaacactcatcttcaaaagactgggactgctgagatgtcctctattcttgaagagcgtattcttggagctgatacctctgttgatcttgaagaaactgggcgtgtcttaagtattggtgatggtattgcccgcgtacatgggctgaggaatgttcaagcagaagaaatggtagagttttcttcaggcttaaagggtatgtccttgaacttggaacctgacaatgttggtgttgtcgtgtttggaaatgataaactaattaaggaaggagatatagtgaagaggacaggagccattgtggacgttccagttggtgaggagctgttgggtcgtgtagttgatgcccttggtaatgctattgatggaaagggtccaattggttccaagacgcgtaggcgagttggtctgaaagcccccggtatcattcctcgaatttcagtgcgggaaccaatgcagactggcattaaggctgtggatagcttggtgccaattaggcgtggtcagcgtgaactgattattggtgaccgacagactgggaaaacctcaattgctattgacacaatcattaaccagaaacgtttcaatgatggatctgatgaaaagaagaagctgtactgtatttatgttgctattggtcaaaagagatccactgttgcccagttggtgaagagacttacagatgcagatgccatgaagtacaccattgtggtgtcggctacggcctcggatgctgccccacttcagtacctggctccttactctggctgttccatgggagagtattttagagacaatggcaaacatgctttgatcatctatgacgacttatccaaacagatcttcttggaaacagaattgttctacaaaggtatccgccctgcaattaacgttggtctgtctgtatctcgtgtcggatccgctgcccaaaccagggctatgaagcaggtagcaggtaccatgaagctggaattggctcagtatcgtgaggttgctgcttttgcccagttcggttctgacctcgatgctgccactcaacaacttttgagtcgtggcgtgcgtctaactgagttgctgaagcaaggacagtattctcccatggctattgaagaacaagtggctgttatctatgcgggtgtaaggggatatcttgataaactggagcccagcaagattacaaagtttgagaatgctttcttgtctcatgtcgtcagccagcaccaagccttgttgggcactatcagggctgatggaaagatctcagaacaatcagatgcaaagctgaaagagattgtaacaaatttcttggctggatttgaagcttaa

SEQ ID NO: 254 - DNA, 1523 bp, Homo sapiens
  CDS (93)..(1523)
aaggatccttaattaaattaatcccccccccccccgccagtcagtccggaggctgcggctgcagaagtaccgcctgcggagtaactgcaaagatgctgtccgtgcgcgttgctgcggccgtggtccgcgcccttcctcggcgggccggactggtctccagaaatgctttgggttcatctttcattgctgcaaggaacttccatgcctctaacactcatcttcaaaagactgggactgctgagatgtcctctattcttgaagagcgtattcttggagctgatacctctgttgatcttgaagaaactgggcgtgtcttaagtattggtgatggtattgcccgcgtacatgggctgaggaatgttcaagcagaagaaatggtagagttttcttcaggcttaaagggtatgtccttgaacttggaacctgacaatgttggtgttgtcgtgtttggaaatgataaactaattaaggaaggagatatagtgaagaggacaggagccattgtggacgttccagttggtgaggagctgttgggtcgtgtagttgatgcccttggtaatgctattgatggaaaggaggccacatgtgcctcacaacgacgtataggcgagaaaacctcaattgctattgacacaatcattaaccagaaacgtttcaatgatggatctgatgaaaagaagaagctgtactgtatttatgttgctattggtcaaaagagatccactgttgcccagttggtgaagagacttacagatgcagatgccatgaagtacaccattgtggtgtcggctacggcctcggatgctgccccacttcagtacctggctccttactctggctgttccatgggagagtattttagagacaatggcaaacatgctttgatcatctatgacgacttatccaaacagagagcagccaaaatgaacgatgcttttggtggtggctccttgactgctttgccagtcatagaaacacaggctggtgatgtgtctgcttacattccaacaaatgtcatttccatcactgacggacagatcttcttggaaacagaattgttctacaaaggtatccgccctgcaattaacgttggtctgtctgtatctcgtgtcggatccgctgcccaaaccagggctatgaagcaggtagcaggtaccatgaagctggaattggctcagtatcgtgaggttgctgcttttgcccagttcggttctgacctcgatgctgccactcaacaacttttgagtcgtggcgtgcgtctaactgagttgctgaagcaaggacagtattctcccatggctattgaagaacaagtggctgttatctatgcgggtgtaaggggatatcttgataaactggagcccagcaagattacaaagtttgagaatgctttcttgtctcatgtcgtcagccagcaccaagccttgttgggcactatcagggctgatggaaagatctcagaacaatcagatgcaaagctgaaagagattgtaacaaatttcttggctggatttgaagcttaa

SEQ ID NO: 255 - DNA, 3140 bp, Homo sapiens
  CDS (122)..(700)
tgacgcggcgttagtattggccgtgtacccgaaaaactgattgactgggctggcgttaactgtgcggaggcaggatttccctggggaaagtcttcactcagagcttcgctgacagccaaggatggcaagcaaggggccctcggcctctgcatctcctgagaactccagtgcaggggggcccagtgggagcagcaatggcgctggcgagagcggagggcaggacagcactttcgagtgcaacatctgcttggacacagccaaggatgccgtcatcagcctgtgtggccacctcttctgttggccgtgtttacatcagtggttggagaccagacctaacagacaggtgtgtcctgtttgcaaagctggcatcagccgagacaaggtcatccccctctatggaaggggcagcactgggcaacaggaccccagagagaagacccctcctcgtcctcaaggacagaggccagagccggagaatagagggggatttcaaggatttggatttggagatggtggcttccagatgtcttttggaattggggcatttccctttgggatatttgccacagcatttaatataaatgatgggcggcctcctccagctgtccctgggacaccccagtatgtggacgagcagttcctgtcacgcctcttcctatttgtggccctggtgatcatgttctggctcctgattgcctaatgctgggctcctgcctacatccgtggcagggctctggactggtgacgtgccaccccaactcctggtgtttggcttcctggctaatcttgactcctggaatcagtgggatcagtaacacatcaaggagtcttgtttcttcatcagagctttggaactcgagaccagttggcgatgacccctgaatatcgccaccgctgtaaacactctataacttcaggccttggcattgagtcatctctcatgggtgacaccatgaaatcttgtttcagccagttctgcaggtcctgactctgcagagggaagaggcagaaagagagaaactgtcagagtataatttcacctgagtttaatattacagaaacaaagggatgcaccaaatggtatttctggaaattttcatgtctttaaataccccttggtaagttgcttctgaagccagtgggggctcctcagatagagaggttcccctttcaaatcccagtgccgctctgttctctttccttcccctcccactccccctcttcttcctctgtagagatgcaagaaattgctgtcccataaaaatcataattgcagtagctaaagctggggtcacttcgtgaattcaccagagactcaaagatcttttattggctctgggctgtgctcagtgtctttggcctcagagaacaacttgaatgacttcctggtttcctggcataaattattcctggtgagacatgtggcttaactcacaggtttcccatcagctttctccctaaaactatgttcatctgcctctctctgccagagaacatacagccgagaatactgccgaagctgagactgactactgtgcattaggaaagacctggagtcaggactttggtgggatttggagctccgaggcagtaataactgaacaagcagccctgtcccctaggctgcagaagcttgaatgcatcctctcccagaacctgccacaggaaactgggggctttgtcaggtcagcccaactgcatgcaaaagaccaccatcctcagaagccaagttgtcttttatgaagaggcaaggaaaggggaaacccacatgtgaccctgattttggtatggcttgatagagttccctgaaaactccttgtatgtgtgctaaaaccagggaagcatgtgactgccaagcaggcaacccctgatgatttgtaaagccaggtggcagggccttggggagccccagcacaatgatattgtgtggtcttccctcctgtggaatcgaggggaaattattcttcccaataccttgatttgattttcagtttcataagcttcttcctctgaatcttattgagggactatggtaccaagcaggtaggactgttcacctggtggaacagttcttgctctgccttctaggcttcatcccagaaatccagcctctttctggagaccccaaagctggagggagatgggctttcctctgggcctctctcctactttgccatccacactgctcctggctaaccccagcaataaccaacaaatggtaggaagccccatctattgctttttctcaattatgactgcatagtttatggaaacaaagatcttgaggaagatgagggaagccctcccctcttcatagtccccatctcttctcctttgtacctgtcaacaccagagttcagtgtttaaacagacaaaatataaagtattgagtaggtggttcatatgccgaatccacttggtaggaagaaaccaccagctttatagtgtgcctgatagattttaaacattcctgggcacccactcaagagtgctctttttatcaccttctggaaatccgcaaagttgcaggggcctctggagtgtctcttctctagagagaattggtgggacccccctcagtgcagtggccccaactagtggagggagagaggacttaagtcagatggactcaacagaaatgggtttccagaagaataatgaaaagttgtgggtaggaaaatgaatcatttggactcttcaatgaaatggagtgagcccaggagagctcagccaacagaggcactctgggaacctgttagtaaagccaggctggccaaatgccatttgattttgaacctcgtaggtccccactcaccctctgccaggagctaagtaaggcaggagagctgacttgggactcctggctcggccccaacagggagcccccttcccaccatccctcggcaagctcaccacctcatccttctgccaaggcagctttcctttcttttgtgtgttttctgtgttcttagcctccaccctcctcctgccacccttgtggactaggaccaggtcctgaccccagtcagaaaatgatgatatgtacagtggcacaccttaaccagtcactaattttcactgttgtgaaagtgatttgatttagaattaaacaaatggttttacattacaaaaaaaaaaaa

SEQ ID NO: 256 - DNA, 2168 bp, Homo sapiens
  CDS (57)..(1634)
aaggatccttaattaaattaatccccccccccccccccccgatgtgacaatccaagatggcggtgcccggcgaggcggaggaggaggcgacagtttacctggtagtgagcggtatcccctccgtgttgcgctcggcccatttacggagctattttagccagttccgagaagagcgcggcggtggcttcctctgtttccactaccggcatcggcctgagcgggcccctccgcaggccgctcctaactctgccctaattcctaccgacccagccgctgagggccagcttctctctcagacttcggccaccgatgtccggcctctctccactcgagactctactccaatccagacccgcacctgctgctgcgtcatctcggtaagggggttggctcaagctcagaggcttattcgcatgtactcgggccgccggtggctggattctcacgggacttggctaccgggtcgctgtctcatccgcagacttcggctacctacggaggcatcaggtctgggctcctttcccttcaagacccggaaggaactgcagagttggaaggcagagaatgaagccttcaccctggctgacctgaagcaactgccggagctgaacccaccagtgctgatgcccagagggaatgtggggactcccctgcgggtctttttggagttgatccgggcctgccgcctaccccctcggatcatcacccagctgcagctccagttccccaagacaggttcctcccggcgctacggcaatgtgccttttgagtatgaggactcagagactgtggagcaggaagagcttgtgtatacagcagagggtgaagaaataccccaaggaacctacctggcagatataccagccagcccctgtggagagcctgaggaagaagtggggaaggaagaggaagaagagtctcactcagatgaggacgatgaccggggtgaggaatgggaacggcatgaagcgctgcatgaggacgtgaccgggcaggagcggaccactgagcagctctttgaggaggagattgagctcaagtgggagaagggtggctctggcctggtgttttatactgatgcccagttctggcaggaggaagaaggagattttgatgaacagacagccgatgactgggatgtggacatgagtgtgtactatgacagagatggtggagacaaggatgcccgagactctgtccaaatgcgtctggaacagagactccgagatggacaggaagatggctctgtgatcgaacgccaggtgggcacctttgagcgccacaccaagggcattgggcggaaggtgatggagcggcagggctgggctgagggccagggcctgggctgcaggtgctcaggggtgcctgaggccctggatagtgatggccaacaccccagatgcaagcgtggattggggtaccatggagagaagctacagccatttgggcaactgaagaggccccgtagaaatggcttggggctcatctccaccatctatgatgagcctctaccccaagaccagacggagtcactgctccgccgccagccacccaccagcatgaagtttcggacagacatggcctttgtgaggggttccagttgtgcttcagacagcccctcattgcctgactgaccgggttgggggcttcctttcatagctacatgatgaaaaccctctgccctggcctcatctaccactgaagcagaaaggagtctgggagcagcagtcttcgtggctggttcagggtgttttgttccgagcctgcctgcctgccggttctatacctcaggggcatttttacaaaaagccccctcccgtcccctccccttggatattaggggtaacgaccgcttgtctttggtctctaaccctaatctctgggcttgccctttgcctcctgcagaactttgaaaagctgggttgagtgaggctatcagcacagccttccttggggactctgaaggtgtccccacgaaggccagaaagggggaaagggacctgggcgaggagaggatttgtggtgcttggaagagccggccttgggtgggccctccaccgcctctaccctcactgggtgggactgccagcggagagtccgcgggaggtggcttgggtgtgcgacgtcacggaagaataaagacgtttactactggaaaaaaaaaaaaa

SEQ ID NO: 257 - DNA, 724 bp, Homo sapiens
  CDS (128)..(697)
ctgacatcaccacggcggcagccctttaaacccctcacccagccagcgccccatcctgtctgtccgaacccagacacaagtcttcactccttcctgcgagccctgaggaagccttctttccccagacatggccaacaagggtccttcctatggcatgagccgcgaagtgcagtccaaaatcgagaagaagtatgacgaggagctggaggagcggctggtggagtggatcatagtgcagtgtggccctgatgtgggccgcccagaccgtgggcgcttgggcttccaggtctggctgaagaatggcgtgattctgagcaagctggtgaacagcctgtaccctgatggctccaagccggtgaaggtgcccgagaacccaccctccatggtcttcaagcagatggagcaggtggctcagttcctgaaggcggctgaggactatggggtcatcaagactgacatgttccagactgttgacctctttgaaggcaaagacatggcagcagtgcagaggaccctgatggctttgggcagcttggcagtgaccaagaatgatgggcactaccgtggagatcccaactggtttatgaagaaagcgcaggagcataagagggaattcacagagagccagctgcaggagggaaagcatgtcattggccttaaatgggccagaacagaagggccttccaagccggtttaacaggtacggacaaccttggagaaatcg

SEQ ID NO: 258 - DNA, 1411 bp, Homo sapiens
  CDS (8)..(1150)
actaaggatgcggtcccgggttctgtggggcgctgcccggtggctctggccccgccgggccgttggcccagcccgccggcccctgagctccggtagcccgccgctggaggagctgttcgcccggggcgggcccttgcggaccttcctcgagcgccaggcggggtctgaagcccatttgaaggtcaggaggcccgagttgctggcggtgatcaaactgctgaacgagaaggagcaggagctgcgggagactgagcacttgctgcacgatgagaatgaagatttaaggaaacttgcagagaatgaaatcactttgtgtcaaaaagaaataactcagctgaagcatcagattatcttacttttggttccctcagaagaaacagatgaaaatgatttgatcctggaagtaactgcaggagttggaggtcaggaggcaatgttgtttacatcagagatatttgatatgtatcagcaatatgctgcatttaaaagatggcattttgaaaccctggaatattttccaagtgaactaggtggccttagacatgcatctgccagcattgggggttcagaagcctataggcacatgaaatttgaaggaggtgttcacagagtacaaagagtgccaaagacagaaaagcaaggccgcatccatactagcaccatgactgtagcaatattaccccagcctactgagattaatctggtgattaatccgaaagatttgagaattgacactaagcgagccagtggagctggggggcagcatgtaaataccacggacagtgctgtccggatagttcatcttccaacaggtgttgtttctgaatgtcaacaagagagatctcagctgaaaaataaagagctggctatgacaaagttacgtgcaaaactgtacagcatgcatctagaagaagaaataaataaaagacagaatgctagaaaaattcagattggaagtaaaggaagatcagagaaaataagaacatataattttccacagaaccgggtcacagatcacagaataaacaagacgctgcatgatcttgaaacttttatgcaaggagattatctactggatgaacttgtacagtcattgaaggaatacgccgattatgaatctttagtagaaattatttcccaaaaagtttaagttgatttgttatttatagactttcgtagcttagaaaaattctacagtacatccacatagggtgaaagtacccttactctcttgaaaaacgttgagttaacacagttggaggtaatatgcatattctgaagtcatagataatttacacagatctctctcaatgcattagcaaaaatcatacaatatacagatggtcctcgatttacattgtggttaattcccaataaacccatcataagttaaaaatgcaaaaaaaaaaaa

SEQ ID NO: 259 - DNA, 1303 bp, Homo sapiens
  CDS (8)..(1042)
actaaggatgcggtcccgggttctgtggggcgctgcccggtggctctggccccgccgggccgttggcccagcccgccggcccctgagctccggtagcccgccgctggaggagctgttcgcccggggcgggcccttgcggaccttcctcgagcgccaggcggggtctgaagcccatttgaaggtcaggaggcccgagttgctggcggtgatcaaactgctgaacgagaaggagcaggagctgcgggagactgagcacttgctgcacgatgagaatgaagatttaaggaaacttgcagagaatgaaatcactttgtgtcaaaaagaaataactcagctgaagcatcagattatcttacttttggttccctcagaagaaacagatgaaaatgatttgatcctggaagtaactgcaggagttggaggtggccttagacatgcatctgccagcattgggggttcagaagcctataggcacatgaaatttgaaggaggtgttcacagagtacaaagagtgccaaagacagaaaagcaaggccgcatccatactagcaccatgactgtagcaatattaccccagcctactgagattaatctggtgattaatccgaaagatttgagaattgacactaagcgagccagtggagctggggggcagcatgtaaataccacggacagtgctgtccggatagttcatcttccaacaggtgttgtttctgaatgtcaacaagagagatctcagctgaaaaataaagagctggctatgacaaagttacgtgcaaaactgtacagcatgcatctagaagaagaaataaataaaagacagaatgctagaaaaattcagattggaagtaaaggaagatcagagaaaataagaacatataattttccacagaaccgggtcacagatcacagaataaacaagacgctgcatgatcttgaaacttttatgcaaggagattatctactggatgaacttgtacagtcattgaaggaatacgccgattatgaatctttagtagaaattatttcccaaaaagtttaagttgatttgttatttatagactttcgtagcttagaaaaattctacagtacatccacatagggtgaaagtacccttactctcttgaaaaacgttgagttaacacagttggaggtaatatgcatattctgaagtcatagataatttacacagatctctctcaatgcattagcaaaaatcatacaatatacagatggtcctcgatttacattgtggttaattcccaataaacccatcataagttaaaaatgcaaaaaaaaaaaa

SEQ ID NO: 260 - DNA, 1575 bp, Homo sapiens
  CDS (1)..(1152)
atggaaaaactcaagcctggagaaattaagagctttgcccatggtcccacaatagacagtcaagtgcattctcaagccctgctccgcaccctctccctagttacccccgggactcagtctaaagaacgccggagcgctgaggtggtaaatgacttccccaaggtcacctcaggaagaggggctgccgggaccaaagctggccccgcgggtgcctggcctgtgggcagccggaccgacacgatgtggcggctccgctgcaaggccaaggacggcacccatgttttgcaggggctgtccagccggacccgggtgcgggaactccagggccaaattgccgccatcaccgggatcgcccccggcggtcagcgaatcctcgtcggataccctcccgagtgcctggatctcagcaatggggataccattctggaagacttgcccatccaatctggtgacatgctgatcattgaagaagaccaaaccaggcccagaagttcacctgcatttactaaacgtggtgcttctagttacgtcagggaaactttgcctgtgcttaccagaaccgtggtcccagcagacaactcttgcctctttactagtgtgtactatgtcgtcgaaggaggagtcttgaatccagcttgtgcccctgagatgagacgcctcatagcacaaattgtagcaagcgatccagacttctatagtgaggcaatactgggaaaaacaaatcaagagtactgtgactggatcaaaagggatgacacttggggaggagcaatagagatatcgattttgtccaagttttaccaatgtgaaatatgtgtagtggatacacacacagtaagaattgatcgttttggggaagatgcaggatataccaaaagggttctgcttatttatgatggcatccactatgatccacttcagcgtaacttccctgatccagatacacctcctctgaccattttctcctctaatgatgatattgttcttgtacaagcactggaattagcagatgaagctagaagaaggagacagtttactgatgtcaaccgcttcaccctgagatgcatggtatgtcagaaaggattaactggacaagcagaagcaagggaacatgccaaggagacaggccataccaactttggagaagtgtgacctatgcatgaatgagggttgaagcctactacctcacacatccagaaggctctgggttttccaataagctatggtaaccctaaagaacaaaggatacaatgcttgaaccatccttttaacttaaaaccactaagacactgaaattccttgttaagattaaaattagtgtgcaagtttacagatgtgtgtctacagtggtaaactgtacatacatgcctctttctgctggagtgacagaataggtgatccttgccacctactgacactgacctgaaggttgagattgagtattataaactagcacccagcagctttaacttgtagaagaaagcatcacattttgggtaatgtggaaggcctcctgtgagtccactgggcatacgataaagatagagtattataaactagcacccagcatgtatt

SEQ ID NO: 261 - DNA, 3112 bp, Homo sapiens
  CDS (110)..(2986)
gggtctctgggtctagtgagctgcgcggagtgcggcagcaacgggccgggccgggccttcgggcccgaggcggcggcggcggtataaagccggcgactgggagcatgtaatgtcggaatgcggaggccgcggcggcggcagcagcagcagcgaggacgccgaggacgagggagggggcggcggcggccccgcgggctcagactgcctcagctcgagcccgaccctggccacagcgtcctcggcgggccggctccgtcgcgggctgcgtggcgccttcctcatggcgcgccagcggccggagctgctctgcggggccgtggcgctcggctgcgcgctgctcctcgccctcaagttcacctgcagtcgagcaaaagatgtgataataccagcaaagccacctgtcagctttttctccttgaggtctccagtccttgacctcttccaggggcagctggattatgcagagtacgttcgacgggattcagaggtggtactgctcttcttctatgccccttggtgtggacagtccatcgctgccagggcagaaattgagcaagcagcaagtcggctttcagatcaggtgttgtttgtggcaattaactgttggtggaaccaggggaaatgcagaaaacagaaacacttcttttattttcctgtaatatatctgtatcatcggagttttggaccaatcgaatacaaaggccccatgagtgctgtttacattgagaagtttgtccgccgggtgatgaaaccacttctctacatcccatctcaatcagaattactagattttctctcaaactacgagcctggagtactcgggtactttgagttcagtggctcaccccagcctcctggttatttgaccttcttcacctcagcattacattcattaaagaaagattacctaggaacagtacgatttggggttatcacaaataaacatcttgcgaaactggtatccttagtacactctggaagtgtgtatttacatagacatttcaacacatcacttgtcttccccagggaggtcctgaactacacagctgagaacatctgtaagtgggccttagaaaaccaggagacgctctttcggtggctgcggccacacggaggcaagagtctcctgctgaataacgagctgaagaaaggaccagcgctgtttctgttcataccttttaatcccctggccgaaagtcatcctttaatagacgagatcaccgaagtggccttggagtacaacaactgtcatggggaccaggtggtggagcgtctccttcagcacctgcggcgggtggatgctccagtgctggagtccctggccctggaagtgccggcacagctgccagacccgccaacgatcacagcgtccccctgctgcaacactgtggtgctgccccagtggcactccttctccaggacccacaacgtctgtgaactctgtgtcaaccagacctccgggggcatgaagccgagctcggtcagcgtgccacagtgcagcttttttgaaatggcagcagctctggattctttctacctcaaggagcagaccttttatcatgtggcatcagacagcatagaatgcagcaattttttaacttcctatagccccttcagctactacactgcatgttgcaggaccataagcaggggtgtgtcaggcttcatcgactctgaacaaggtgtctttgaagcccctactgttgcattttcttcccttgagaagaaatgtgaggttgatgccccaagctccgttcctcacattgaggagaacaggtatctctttccagaagtggacatgactagcacaaacttcacaggcctgagctgcagaaccaacaagactctcaacatctaccttttggattcaaatttgttttggttatatgcagagagactgggtgctccgagctccactcaggtgaaagaatttgcggcaattgttgacgtgaaagaagaatctcattacatcttggatccaaagcaagcactgatgaagctcaccctagagtcttttattcaaaacttcagcgttctctatagtcccttgaaaaggcatctcattggaagtggctctgcccagttcccgtctcagcatttaatcactgaagtgacaactgataccttttgggaagtagtccttcaaaaacaggacgttctcctgctctattacgctccgtggtgcggcttctgtccatccctcaatcacatcttcatccagctagctcggaacctgcccatggacacattcactgtggcaaggattgacgtgtctcagaatgaccttccttgggaatttatggtcgatcgtcttcctactgtcttgttttttccctgcaacagaaaggacctaagtgtgaaataccccgaagacgtccctatcacccttccaaacctgttgaggttcattttgcatcactcagaccctgcttccagcccccagaatgtggctaactctcctaccaaggagtgtcttcagagcgaggcagtcttacagcgggggcacatctcccacttggagagagagatccagaaactgagagcagaaataagcagcctccagcgagcacaagtgcaggtggagtcccagctctccagtgcccgcagagatgagcaccggctgcggcagcagcagcgggccctggaagagcagcacagcctgctccacgcacacagtgagcagctgcaggccctctatgagcagaagacacgtgagctgcaggagctggcccgcaagctgcaggagctggccgatgcctcagaaaacctccttaccgagaacacgtggctcaagatcctggtggcgaccatggagaggaaactggagggcagggatggagctgaaagcctggcggcccagagagaggtccaccccaagcagcctgagccctcagccaccccccagctccctggcagctcccctccacctgccaatgtcagcgccacactggtgtctgaaaggaataaggagaacaggacagactaactttttaaatgatatgaagaaatcagaggtgaaaattgtacattgggaatatatttatgcaaattttattgaaatttattgtaaataaagattttctcagtggtctagaaaatcaaaaaaaaaaaa

SEQ ID NO: 262 - DNA, 1771 bp, Homo sapiens
  CDS (90)..(1397)
ccgagcgaaggaaggaagggaggcgcgctgtgcgccccgcggagcccgcgaaccccgctcgctgccggctgcccagcctggctggcaccatgctgcccgcgcgctgcgcccgcctgctcacgccccacttgctgctggtgttggtgcagctgtcccctgctcgcggccaccgcaccacaggccccaggtttctaataagtgaccgtgacccacagtgcaacctccactgctccaggactcaacccaaacccatctgtgcctctgatggcaggtcctacgagtccatgtgtgagtaccagcgagccaagtgccgagacccgaccctgggcgtggtgcatcgaggtagatgcaaagatgctggccagagcaagtgtcgcctggagcgggctcaagccctggagcaagccaagaagcctcaggaagctgtgtttgtcccagagtgtggcgaggatggctcctttacccaggtgcagtgccatacttacactgggtactgctggtgtgtcaccccggatgggaagcccatcagtggctcttctgtgcagaataaaactcctgtatgttcaggttcagtcaccgacaagcccttgagccagggtaactcaggaaggaaagatgacgggtctaagccgacacccacgatggagacccagccggtgttcgatggagatgaaatcacagccccaactctatggattaaacacttggtgatcaaggactccaaactgaacaacaccaacataagaaattcagagaaagtctattcgtgtgaccaggagaggcagagtgccctggaagaggcccagcagaatccccgtgagggtattgtcatccctgaatgtgcccctgggggactctataagccagtgcaatgccaccagtccactggctactgctggtgtgtgctggtggacacagggcgcccgctgcctgggacctccacacgctacgtgatgcccagttgtgagagcgacgccagggccaagactacagaggcggatgaccccttcaaggacagggagctaccaggctgtccagaagggaagaaaatggagtttatcaccagcctactggatgctctcaccactgacatggttcaggccattaactcagcagcgcccactggaggtgggaggttctcagagccagaccccagccacaccctggaggagcgggtagtgcactggtatttcagccagctggacagcaatagcagcaacgacattaacaagcgggagatgaagcccttcaagcgctacgtgaagaagaaagccaagcccaagaaatgtgcccggcgtttcaccgactactgtgacctgaacaaagacaaggtcatttcactgcctgagctgaagggctgcctgggtgttagcaaagaagtaggacgcctcgtctaaggagcagaaaacccaagggcaggtggagagtccagggaggcaggatggatccccagacccctacccttcagcgttgcccatggccctgccacatcccgtgtaacataagtggtgccccccatgtttgcccttttaataactcttacttgcgtgttttgtttttggtttccttttaaacccccaatttctaatcccccagtgggaaaaggaaagggaagaaagactttattctctctctcattgtaagtttttggatctgctactgccaacttttaaagggttttgggggggtgggggagggtgttcttgggcctgaaaagaaagagatttatatgctgtatataaataaatatgtaaattgtaaaaaaaaaaaa

SEQ ID NO: 263 - DNA, 1402 bp, Homo sapiens
  CDS (160)..(1386)
ggaatccctgtgctgatcgtggggcatcatatcctgtatgggaaaatcatccacctggagaaaccttttgcagtccttgtcaaacacactcctggggatcaggactgtgatgagcttggccgcgagactggcacccggtacctgcgtccccaagaaagtatgaaagaacctcggattttccctagagagcggccaactccttggactcgtgctccgctgccacctcgaggacggctcgacggttccctgggaccacaggggggtcctgttctgaacacaggccacccactgggtgtgaactcggatcccttccttatggcggccggttctcttggtggaaatctgaccccatttccaaggaacccatctccttttccagcttcatcaggctcattggcttcaaatccagcacctttcccggctggtgctcgtgacccaagtatggcttcttttccaagagggatgaatcccactggcacaggtgcagtttctttcccaaggcctggtggcctcttggggccaggcccaggcccaggccccaccctaaaccctaggacaggggctctgccaggcccagggcctctgtctaaccccaggttagggggtctcccaggaccaggtcctatgtccaacccaagggcaggtggtctcctgggagcaggtcctgaccccagaggtggtggtcccatgggccctggatctggacctaacctgagagccggtgttctgttaacctctgggaatggtcctcccaatcctaggccagttggcctgggcccaggaccaaaccccaatctgagatcaggctttttagggacaaaccctgcccccaggtcaggtgtgtttccaggcccaggccttgggcccaacccaagaccaagtggcctgggcccaggccctaatctagatgccagagcaggtggcctcttgggcacaggatctggtcttaacttaagaatggctggacctcaaggcctcgatcttgcccccattctaagagcagcaggtcttttaggagcaaattcagcttctttctcacaggcttctggaaacatgggcacaagcccatcctccatggcaagagtacctggccccatgggcccaaactcgggtcctagctctcggggaattggccttccagggccaaatccatctcccatgtcaagggctcctggccccataggccctaattcagctcatttctcaaggccagttggccccatgggggtaaatgccaatccctttcccaggggagcaggttcatctgccttttctcagtcttctggcacattggcatcaaacccaggtaccttccaaggtccgctggcctcagggctcaaatccaccattttcccagaggcttgggcccctggcccaacccagtaaattccaggggccttgg

SEQ ID NO: 264 - DNA, 1728 bp, Homo sapiens
  CDS (199)..(1224)
tttcgtgtgggagcagggcgagacgggccattttcactctgtggtcaaaggaaatgactggtctgactcggtctgggagcggggcacccagggtctaaggataactctggggccatgacagccatgagtctcacagaggaccccgagacttctgtgctgcgagtaaccggacttgttctgagacctttgccctagaggatggccaaggggctcctggtgacctatgccctctgggctgtggggggccctgctgggctccaccacctgtacctgggaagggacagccacgccctgctctggatgctgaccctggggggaggtgggctgggctggctctgggagttctggaagctcccaagctttgtagctcaggccaacagagcccagggacagaggcagagccccagaggggtgacaccccctctgagtcccattcgctttgctgcccaggtgatagttggcatctattttggccttgtggcactgattagcctttcttccatggtcaacttctatattgtggccctcccactggcagttggcttaggggtcttgctggtggctgctgttggcaaccagacctcagactttaagaacactctggggtcagcatttctcacttcacctatcttctatggccgccccatagccatactgcccattagcgtggccgccagcattacagctcagaggcatcgccgctacaaagctttggtggcatcagagccgctcagtgtgcggctctatcgtctgggcttggcttaccttgctttcacaggcccactggcatacagtgccctctgcaacacagctgccaccctcagctatgtggcagaaacctttggctccttcttgaattggttcagcttcttcccccttcttggccgcctcatggagtttgtcctccttctgccttaccggatctggaggctactgatgggggagactggcttcaacagcagctgctttcaggagtgggcgaagctctatgagtttgttcacagttttcaggatgagaagcgtcagctggcttaccaggttttgggcctctcagaaggggcaacaaatgaagaaatacatcggagttaccaggagctagtgaaggtctggcacccagaccacaacctggaccagacagaggaggcacagaggcacttcctggagatccaggctgcgtatgaagtcctgagtcaacccaggaagccctggggatcccggaggtgaaaagaaacttccccctgaggactgactcttcctagcagagctgggcaacttgtcccaaatctagctttgcccacgaatggcatcccaacagagttaaagaaactgcttgcaggggcatgagctactgaccccagcctagatgacctttaagcttgctttcaacctgcattctggagttattagcttttcagctgaggtttttattaaatggttttatttgtcatcttctgtctgcccccttgtggacattgttttgggaagaaaataaaatatttaattgctcgaagaacaatataatgaccatctcaccctccaaaaattcacttgcatcacactgtttgttttcagttattcatgttcacttctagtcgtcgttcataaatgtacatcattttacatggttgaatcatatcagggacataattttgtactttcccccctccctgataaagatgatgtttttacagtaaaataaaaaaatgcttgtgattcaaaaaaaaaaaa

SEQ ID NO: 265 - DNA, 3097 bp, Homo sapiens
  CDS (20)..(3007)
gatccacgagctgcacttcatggacgagctggtcaaggtggaggcccatgatgctgaggtgctgtgcctggagtactccaagccagagacggggctgaccttgctggcctcagccagtcgggaccggctgatccatgtgctgaacgtggagaagaactacaacctggagcagacgctggatgaccactcctcctccatcaccgccatcaagttcgctggcaacagagacatccagatgatcagctgtggggctgacaagagcatctactttcgcagtgcccagcagggttcggatggactacactttgtccgtacccaccacgtagcagagaaaaccaccttgtatgacatggacattgacatcacccagaagtacgtggccgtggcctgccaggaccgcaatgtgagagtctacaacactgtgaacgggaagcaggaggcgtgctacaagggctcccagggtgacgaagggtccttgctgaaggtccatgtggacccctcaggcaccttcctggccaccagctgctctgacaaaagcatctcagtgattgacttttactcgggcgagtgcattgccaagatgtttggccattcagaaattattaccagcatgaagttcacctatgactgtcatcacttgatcacagtatctggagacagctgcgtgttcatctggcacctgggcccggagatcaccaactgcatgaagcagcacttgctggagattgaccaccggcagcagcagcagtacacaaatgacaagaagcggagtggccaccccaggcaggatacgtatgtgtccacacctagtgagattcactccctgagccctggagagcaaacagaggatgatctggaggaagagtgtgagccagaagagatgctgaagacaccatccaaagatagcttggatccagatcctcgttgcctgctaaccaacggcaagctgccactgtgggcaaagcggctgctaggggacgatgatgtggcagatggcttggccttccacgccaagcgcagctaccagccccacggccgctgggcagagcgggccggccaagagcccctcaagaccatcctggatgcccaggacctggattgctactttacccccatgaagcccgagagtctggagaactccattctggattcactggagccacagagcctggccagcctgctgagtgagtcagagagtccccaggaagctggccgcgggcacccctccttcctgccccagcagaaggaatcatctgaggccagtgagctcatcctctactctctggaggcagaagtgacagtcacagggacagacagccagtattgcaggaaggaggtggaggccgggcctggagaccagcagggcgactcctacctcagggtgtcctccgacagcccaaaggaccagagcccgcctgaggactcgggggagtcagaggccgacctggagtgcagcttcgcagccatccactccccagctccgcctcctgaccctgcccctcggtttgccacgtcgctgccccatttcccaggatgcgcaggtcccacagaagatgagctgtccctgcccgagggacccagcgtccccagcagctccctaccccagactccggagcaggagaagttcctccgccaccactttgagacactgactgagtccccctgcagagctctgggagacgtggaggcctctgaagctgaagaccacttcttcaacccacgcctgagtatctccacgcagttcctctcaagcctccagaaggcatccaggttcacccataccttccctccccgggcaacccagtgccttgtgaagtctccagaggtcaagctcatggaccgaggcggaagccagcccagagcaggtactggctacgcctccccagacaggacccacgtcctcgctgcagggaaggctgaagagaccctggaggcctggcgcccaccacctccctgccttacgagcctggcgtcctgtgtccctgcttcctccgtgctgcccacagacaggaatctcccaacgcccacatctgcacccaccccaggcctggctcagggtgtccatgccccctccacctgttcctacatggaggccactgccagctcccgtgccaggatatcacgcagcatctccctcggtgacagtgagggccctatcgtggccacactggcccagcccctccgtaggccatcgtccgttggggagctggcctccttgggccaggagcttcaggccatcaccaccgcgacaacacccagtttggacagtgagggccaagagcctgccctgcgttcctggggcaaccacgaggcccgggccaacctgagactgaccctgtcaagtgcctgtgatgggctcctgcagccccccgtggatacccagcctggcgtcaccgtccctgcagtgagcttcccagcccctagccctgtggaagagagcgccctgaggctccacggctctgcctttcgcccaagtctcccagctcctgagtcccctggccttcctgcccaccccagtaacccccagcttccagaggcccggcctggcatccctggcggcactgcctccctcctggagcccacctccggtgcacttggtctgttacagggcagccctgcccgctggagtgagccctgggtgccggttgaagccctgcccccatctccccttgagctgagcagggtggggaacatcttgcacaggctgcagaccaccttccaagaagccctcgacctttaccgtgtgttggtctccagtggccaggtggacaccgggcagcagcaggcacggactgagctggtctccaccttcctgtggatccacagccagctggaggctgaatgcctggtggggactagtgtggccccagcccaggctctgcccagcccaggacccccgtccccaccgacgctgtaccccctggccagcccagacctgcaggccctgctggaacactactcggagctgctggtgcaggccgtgcggaggaaggcacgggggcactgagggcgcagcccctccaccgcagccctgctgcttctgaggacttaggtattttaagcgaataaactgacagctttgaggaaaaaaaaaaaa

SEQ ID NO: 266 - DNA, 1525 bp, Homo sapiens
  CDS (263)..(1525)
ttttgtctctgtattttttaacactttcaaaattttcgcaatcagcatatgctataatcagaaaaataatcatttttgttacagatttattatcagagtagatcctttcatataaaggaattttgtcattcccaaagaaaattccaacatcttgttgcagtatattgcttatggagaagagtgagtggtatgtgtcctctttttcactgcaggttctccccaggatatagcagccgtaagaagccaagcagccctccagagcatgcgaacgtcacggctgatggcacagaacgcaggcatgatgggaataggaccctcccagaaccctgggacgatggccaccgcagctgcgcagtcggagatgggactggccccttatagcaccacgcctaccagccaaccaggaatgtacaatatgagcacaggcatgacccaaatgttgcagcatccaaaccaaagtggcatgagcatcacacataaccaagcccagggaccgaggcaacctgcctctgggcagggggttggaatggtgagtggctttggtcagagcatgctggtgaactcagccattacccagcaacatccacagatgaaagggccagtaggccaggccttgcctaggccccaagcccctccaaggctgcagagccttatgggaacagtccagcaaggagcacaaagctggcaacagaggagcttgcagggcatgcctgggaggactagtggagaattgggaccattcaacaatggcgccagctaccctcttcaagctgggcagccgagactgaccaagcagcacttcccacagggactgagccagtcagtcgtggatgctaacacgggcacagtgaggaccctcaacccagctgccatgggtcggcagatgatgccatcgctcccggggcagcaaggcaccagccaggcgaggccaatggtcatgtctggcctgagccagggagtcccaggcatgccagcgttcagccagcccccagcacagcagcagatacccagtggcagctttgctccaagcagccagagccaagcctatgagcggaatgcccctcaggacgtgtcatacaattacagtggcgacggagctgggggttccttccctggcctcccggacggtgcagaccttgtggactccatcatcaaaggcgggccaggggacgagtggatgcaggagcttgatgaattgtttggaattgcaaaggctctgctgtcacaaggagagcaggctgagtttggagcagggtccatccggcagtcctgggacggcttccctctgctggtgcccctggtggcagtccctccaggtggggctggagcctgctggcgcccaatacaaaacccatacatccaggcagatcactacggaagagtcggagcctgtggggttggactggccacactcagtcctgagaaggcgagttgccatggaaagctgggggcagaggtgtttttggagaggaggcggcaggcaaacattgcctttgacttgctctccgcgtacccggggttgtag

SEQ ID NO: 267 - DNA, 2106 bp, Homo sapiens
  CDS (193)..(1764)
gcttcccctcacccgctccacgccctcctggccgagtggagttgggtggtgtcgggagcctctccctgaggggcaccgcgtcttcaggagctgggcctccagtgcggcgcgatgtcaggcgcggtgacagctctgtgagtccgaggccgcggccgtggcgctgggcggctgcggggcctgaccggtccgctcatggtgccgccacgacgccatcgcggggcaggaaggccaggggtgctgagttcttcacctccttttagactgagatctgccaagttttccggcattgctcttgaggatctcagaagggctcttaagacaagactgcaaatggtgtgtgtatttgtcatgaaccgaatgaattcccagaacagtggtttcactcagcgcaggcgaatggctcttgggattgttattcttctgcttgttgatgtgatatgggttgcttcctctgaacttacttcgtatgtttttacccagtacaacaaaccattcttcagcacctttgcaaaaacatctatgtttgttttgtaccttttgggctttattatttggaagccatggagacaacagtgtacaagaggacttcgcggaaagcatgctgctttttttgcagatgctgaaggttactttgctgcttgcacaacagatacaactatgaatagttctttgagtgaacctctgtatgtgcctgtgaaattccatgatcttccaagtgaaaaacctgagagcacaaacattgatactgaaaaaacccccaaaaagtctcgtgtgaggttcagtaatatcatggagattcgacagcttccgtcaagtcatgcattggaagcaaagttgtctcgcatgtcatatcctgtgaaagaacaagaatccatactgaaaactgtggggaaacttactgcaactcaagtagcgaaaattagcttttttttttgctttggggggtttttggcaaatttgtcatatcaagaagcactttcagacacacaagttgctatagttaatattttatcttcaacttccggactttttaccttaatccttgctgcagtatttccaagtaacagtggagatagatttaccctttctaaactattagctgtaattttaagcattggaggcgttgtactggtaaacctggcagggtctgaaaaacctgctggaagagacacagtaggttccatttggtctcttgctggagccatgctctatgctgtctatattgttatgattaagagaaaagtagatagagaagacaagttggatattccaatgttctttggttttgtaggtttgtttaatctgctgctcttatggccaggtttctttttacttcattatactggatttgaggacttcgagtttcccaataaagtagtattaatgtgcattatcattaatggccttattggaacagtactctcagagttcctgtggttgtggggctgctttcttacctcatcattgataggcacacttgcactaagccttacaatacctctgtccataatagctgacatgtgtatgcaaaaggtgcagttttcttggttattttttgcaggagctatccctgtatttttttcattttttattgtaactctcctatgccattataataattgggatcctgtgatggtgggaatcagaagaatatttgcttttatatgcagaaaacatcgaattcagagagttccagaagacagcgaacagtgtgagagtctcatttctatgcacagtgtttctcaggaggatggagctagttagctgtctgttgtctgtagcccagcttgataatggaactatacagcgaagagacaatctctggcaagtttttgtagaaaaaatgtttcagtgcctagtctgaaaaataacagtttgagttctttgaaactctaaaatatatttttctcatacctgttttcttcattttcataatgaagcactttgctatgtagctgtgtacatatcactacagttataggaagtttcagtctacagtccatccaaaggaccaacctgccttacacatctcaaggaattcagctgttgaaatcatttgaactaatcaaggaataaatcctaatgttctgggaaaaaaaaaaaaaa

SEQ ID NO: 268 - DNA, 959 bp, Homo sapiens
  CDS (174)..(557)
tgcttttgtcttcttcacaaaccttgctgaccagtatcagagttgaatttaggacctatttcagggaactggaaaaggaggaggtgagtattgattttcatgggaaccctgaggagcagcatctgacggccaagggccactgggaaggaggccttccaggaggagatgcactaatggcccctgcagagaagggtgggaagaagaagggctctcctgctgtcaatgaggtggtgacacaagaatacaccatcaacattcacaagcacatccatggagtgggcttcaagaagcgtgcacctcgggcactcagagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccacataagctatatactttggttacctatgtacctgttaccactttcaaaatttctgtgctaaacagtgttacagtcgccaagagcccataaatggagccctcctggaagtggatgaggccttgtgtctcggctcttcattgcttcctgagctgcagcagatgcctttacaaccaagctcaccgaggacgtctgtctcccatattacactggcagagggccaggcctgttctacacggccggggtttcaacaaggtactgatgtcttctgcccttgcctcttcgacaggcaagtaataagacttaagtgaagagaattctttaggcacacaaattcacatttgatgtaatctcattatacttcctgatctgtgattgaaaactttcatttcgtaactagtatgtctgtcccacctttaaaaagtttttcattatgaaagtaagtatttgttagaattaagtctatttaaatgaaaaataaaaaaaaaaagatct

SEQ ID NO: 269 - DNA, 470 bp, Homo sapiens
  CDS (45)..(347)
aggactgagactctggttagggcgccctccccactggtaccaacatgaagctggtttcagcaacggtggtactcctcaccatctgcagccttgaaggagctttggttcggatacaggcaaaggagccatgtgtggagagcctggtttctcagtacttccaaaccgtgactgactatggcaaggacctgatggaaaaggtcaagagcccagagcttcaggccgaggccaagtcttactttgaaaagtcaaaggagcagctgacacccctgatcaagaaggctggaacggaactggttaacttcttgagctatttcgtggaacttggaacacagcctgccacccagtgaagtgtccagaccattgtcttccaaccccagctggcctctagaacacccactggccagtcctagagctcctgtccctacccactctttgctacaataaatgttggatgtatcccaaaaaaaaaa

SEQ ID NO: 270 - DNA, 2585 bp, Homo sapiens
  CDS (474)..(2453)
ggcatctgggctgagatgcaaaggaagaatgggaattaggtgaaaaaatcagaggcgaggggtagcattacaggggaggggatagctagtgcagaggcccggaggtaaagtgccagactcagctctttggagcaaccgaacagtttctagaggctgggtgcagctctccattggattagaggttcacaggggaggctggccaagcatgtagtcacatcagggaggagaaggaggagccaaggaagtgactggagaggcaggttggggtcagattgcaggcctttgatgtcctgtgaaggctgttagatcctggtggtgtggcctgctgtgggctcacatgtcttcttgggctggcagacctttccatccggggtttcaccattcttcctttcccccatgctgtgcctctcggaccccaagggacctcagaacagcatgtccggattcgagtcatcaagaagaaaaaggtcattatgaagaagcggaagaagctaactctaactcgccccaccccactggtgactgccgggccccttgtgacccccactccagcagggaccctcgaccccgctgagaaacaagaaacaggctgtcctcctttgggtctggagtccctgcgagtttcagatagccggcttgaggcatccagcagccagtcctttggtcttggaccacaccgaggacggctcaacattcagtcaggcctggaggacggcgatctatatgatggagcctggtgtgctgaggagcaggacgccgatccatggtttcaggtggacgctgggcaccccacccgcttctcgggtgttatcacacagggcaggaactctgtctggaggtatgactgggtcacatcatacaaggtccagttcagcaatgacagtcggacctggtggggaagtaggaaccacagcagtgggatggacgcagtatttcctgccaattcagacccagaaactccagtgctgaacctcctgccggagccccaggtggcccgcttcattcgcctgctgccccagacctggctccagggaggcgcgccttgcctccgggcagagatcctggcctgcccagtctcagaccccaatgacctattccttgaggcccctgcgtcgggatcctctgaccctctagactttcagcatcacaattacaaggccatgaggaagctgatgaagcaggtacaagagcaatgccccaacatcacccgcatctacagcattgggaagagctaccagggcctgaagctgtatgtgatggaaatgtcggacaagcctggggagcatgagctgggggagcctgaggtgcgctacgtggctggcatgcatgggaacgaggccctggggcgggagttgcttctgctcctgatgcagttcctgtgccatgagttcctgcgagggaacccacgggtgacccggctgctctctgagatgcgcattcacctgctgccctccatgaaccctgatggctatgagatcgcctaccaccggggttcagagctggtgggctgggccgagggccgctggaacaaccagagcatcgatcttaaccataattttgctgacctcaacacaccactgtgggaagcacaggacgatgggaaggtgccccacatcgtccccaaccatcacctgccattgcccacttactacaccctgcccaatgccaccgtggctcctgaaacgcgggcagtaatcaagtggatgaagcggatcccctttgtgctaagtgccaacctccacgggggtgagctcgtggtgtcctacccattcgacatgactcgcaccccgtgggctgcccgcgagctcacgcccacaccagatgatgctgtgtttcgctggctcagcactgtctatgctggcagtaatctggccatgcaggacaccagccgccgaccctgccacagccaggacttctccgtgcacggcaacatcatcaacggggctgactggcacacggtccccgggagcatgaatgacttcagctacctacacaccaactgctttgaggtcactgtggagctgtcctgtgacaagttccctcacgagaatgaattgccccaggagtgggagaacaacaaagacgccctcctcacctacctggagcaggtgcgcatgggcattgcaggagtggtgagggacaaggacacggagcttgggattgctgacgctgtcattgccgtggatgggattaaccatgacgtgaccacggcgtggggcggggattattggcgtctgctgaccccaggggactacatggtgactgccagtgccgagggctaccattcagtgacacggaactgtcgggtcacctttgaagagggccccttcccctgcaatttcgtgctcaccaagactcccaaacagaggctgcgcgagctgctggcagctggggccaaggtgcccccggaccttcgcaggcgcctggagcggctaaggggacagaaggattgatacctgcggtttaagagccctagggcaggctggacctgtcaagacgggaaggggaagagtagagagggagggacaaagtgaggaaaaggtgctcattaaagctaccgggcaccttagctcaaaaaaaaaaaa

SEQ ID NO: 271 - DNA, 1956 bp, Homo sapiens
  CDS (252)..(1829)
cctgaaccctgaggaggaagaaagatagaagataagagttaattggcgctaggctttgttgtaggaagtttgtaagttttaaaatagcaagtagattcacgtagaccttgtcaggaaattggtcactatccatctaggccctagaagtgagaggaggaatcttgcgaactcattttctagttgctttgtattcaaatcttagttgttaattatcttgttctagtaatcacctaaaatattagacacttaaaatgttggggaaacgtaagcgtgtggtgttgacaattaaggacaagcttgacattattaagaaacttgaggaaggcatctctttcaaaaaactttccgtggtgtacggaattggtgaatccacagttcgtgatattaaaaagaacaaagaaaggattataaactatgcaaacagttcagatcctaccagtggagtatccaaacgtaaatctatgaagtcatcaacatacgaggagcttgatagagttatgatagagtggtttaaccaacagaaaacagatgggattccagtgtccggaacgatttgtgcaaaacaagccaagttcttttttgatgctttgggaatggaaggtgattttaatgcatcgtcaggctggctaactcgatttaagcagcgccatggtattccaaaggctgctggtaaaggaacaaaattaaaaggagatgaaactgctgccagagaattttgtggtagctttcaggaatttgttgaaaaagagaatctacaaccagagcaaatttatggtgctgatcaaactggattgttttggaaatgtctaccatcaaggacattaactcttgaaactgaccaaagtacttctgggtgtaggtcaagcagagagagaatcatcattatgtgttgcgcaaatgccacaggtttacacaaacttaatctttgtgttgtggggaaggccaaaaagccccgagcattcaaaggcactgacctttcaaaccttcctgtgacatattacagtcaaaaaggtgcatggatagaacagtctgttttcagacagtggtttgaaaagtactttgtgccacaggtacagaagcatttgaaatccaagggacttttagaaaaagcagtgcttcttttagatttccccccagcacgtccaaatgaagaaatgttgagttcagatgatggcagaataattgtgaagtatttgccaccaaatgtcacaagtctgattcaaccaatgagccagggagttctagccactgtaaaaagatactatcgagcaggacttctccagaaatacatggatgaaggaaatgacccaaaaatattttggaagaacttgacagtgttggatgcaatttatgaagtgtcaagagcttggaacatggtaaaatcaagtaccataaccaaagcatggaaaaaacttttccctggcaatgaagagaattcaggtatgaacattgatgaaggagccattttagcagctaatttagcaacagttttacagaacacagaagaatgtgaacatgttgacattgagaatattgatcagtggttcgactctcggagcagtgactcaagctgtcaggtgctgactgacagtgaaagtgctgaggaccagaccaaggctgctgagcaaaagccttccagtaagagtagaaaaacagaactgaatccagagaagcatattagccataaagcggcacttgaatggactgaaaatttactggattatcttgaacaacaagatgacatgcttctgtctgataaattggtattaaggaggcttcggaccataataagaaaaaaacagaagatccaaaataacaaaaatcattaataaggctcttaagtatttcagtgtatctgcatctttgtgactatctgcagtgaaactttgcttgtttgaagtcctgtggattccaaagccaaatacattttataaatgattttggaaaaaaaaaaaa

SEQ ID NO: 272 - DNA, 2375 bp, Homo sapiens
  CDS (116)..(1660)
tttcgtccggtccctcccttcccgccgacaccgcgaagtgcgccctgggcggcggcggccggtgagcgtcccgcgctggagccctcagaggcgggcccgtcagattttttaaaaaatggatttggccaaccatggacttattctactgcaacagttaaacgctcagcgagagtttggtttcctgtgtgactgcacggttgcaatcggcgatgtatacttcaaggcacacaaatcagttcttgcttcattctccaattactttaagatgttgtttgtccatcagaccagtgagtgtgtccgcttgaaaccaactgacatacagcccgacatcttcagctatctcttacacttgatgtacactgggaagatggcgcctcagctcatcgacccggttcgattagaacagggcatcaagtttctgcacgcctacccgctcattcaggaagccagcctcgccagccagggagccttttctcaccctgaccaagttttcccactggcttcttcattgtatggcattcagattgcagatcatcagttgagacaagccaccaagattgcttcagcacctgaaaaactcgggcgagatccacggccacagacctccaggataagccaggagcaggtccctgaggcctcacagctctcccagctgacttcaaatctggcccaggtgaatcggacaaatatgactccctcagaccccctgcagacctcgctgtctccagaacttgtttccactcctgttcctccccctcctcccggggaggagaccaatctggaagcatcttcctccgatgagcagcctgcgtccctcacaatagcccacgtcaagccaagcatcatgaagaggaatgggagctttccaaagtactatgcctgccacctgtgtggacggcgcttcactctccggagcagcttacgtgaacacctccagatccacacaggagtacctttcacatctagccaacagggagaaagtcgcgtccccctgactctctgtagcaatgcagctgacctcgggaaagatgccatggaagtgcctgaagccgggatgataagtgacagtgagctgcagcacatctctgattctcccatcatcgatgggcagcagcagtcggaaaccccacccccctcagacattgctgacattgacaacctggagcaggccgaccaggagagggaggtgaagaggcggaagtacgagtgcacaatatgtggacgcaaatttatccagaaaagccactggagggaacacatgtacatacacaccgggaagcctttcaagtgcagcacttgtgacaaaagcttttgcagggccaaccaggctgcccgccacgtgtgcctcaaccagagcatcgacacttacaccatggtggacaaacagactctggaactctgcacatttgaagaagggagtcagatggacaacatgctggtgcaaacaaacaaaccctacaaatgcaacttgtgtgacaaaacattctccactcccaatgaggttgttaaacattcatgccaaaaccagaactcggatgtttttgccctagacgaagggcgatccattctcctgggcagtggggactcggaagtaacggagcctgaccacccagtgttagcttccatcaaaaaggaacaagaaaccgtcttactagactgaatgtcacttatctttttaaaaaactctcatttttacaaagactatcttccctcccttccctgaattcagaactgtagttctccatggcatgatacaaacaggtccttgttctcttctcctcttccccttttccacatcccagccccacctctgtaaaggctttgtgcattataaacctggaatgtatcgactttctttcaggggatattggaaagataatggtcattatacttataaactcaaattttgagaggttttagattattcagaagcatacttggaactaatgaagggtatataataaaacaactggaatccaatttggtaagctaaaattatgactttccctgggtaaaaagtcttctcagaaaaacaatgtcagaaaataacagcgtgctgcttagaaatacggctgggctctgtactatgcaaaatctagaaagtgtggggaaactttaaacccaagaaaacgttcttagtattcatcctccaggtgtcttacttcagaatgcatcctttgagattatgtccacttaagagaaatcatcagttaagaaatctactttaacaaaacaaaaaggagaaaaagtaataatgtgatggcaatcttaatttttgggtacaacatgacaagctgtgagtttgtgtgtttgtaagagaaaaatgtgtgggtacttgctaataaacaggtgaattaatgcccaaaaaaaaaaaa

SEQ ID NO: 273 - DNA, 4346 bp, Homo sapiens
  CDS (1922)..(3298)
acgaaacgctgttcatttacttgttgtcaggtttatattctacaagcagagcttgtatcgtaacattatcattcaatctaggtatatgtattttgaagtgtagagataatgaggtagtgatactgtcttctagaatagctactctgtcttcatctctgaaattcacaggtctggctagctgtccctaacgtcatttcctggtctcaactcttttaagaccctgacatactctgagattggagtgaagatttctgtgacatgctgggtgggtataggctgctgtctcatgtcttggtcacatcttattgtttattttttcatatcatgtatcacaaattgaaatattgctgatatacttgtttgtcaccctgcatccttctcccattccccaaagtaaagcttcagcagaatagggctttgttgacctgttcactgctgagtcctcagcactgagtgcagtgcgtggtaaatgcccagaaggtgattgtctaaatatgttattttttgagaatatatacgacatgattattatttgaaacaggacaccacaaaaggtaatttttcccttcttctacttgatttctgtcttttcagcctttttcttataccccaccccttttttttggtggcatctcagttcaggatgttctctgtggctgtgaatgctttcccatcttgttcacagttggtacctggaaggttctctaaccttgtttctttctgatgtagcctattctgactctgggattactatttaaagtaattcttttaagagatatgtttggctaattctgtaatttttttgttatgtagactgtttgggagccacatttcctattgatttgatcacaccttattttttccttgtcataaatggtcctttttggatgagttactgtgtgagttctgaccctgtcagaattgatattcttaggaatcctgactttaatatacacagaacaggaaaagtttccttgtcataaatggtcctttttggatgagttactgtgtgagttctgaccctgtcagaattgatattcttaggaatcctgactttaatatacacagaacaggaaaagtcatgataggcacccttgggtatatatggtaacatgttagttctcttcaagactgtgcatggcttacagggatcacaggactgtgtgagttaagcaacagtttaaacctgatgtattgctctcccagaaagtagtattcttaaggtatttaccccagatctgcaagtgtctgtgtttctctgggagggaacccccaaacctggaatgctcatccatatgcattccaacctgcctctgagatgttaggcaagcctcagcagaggttcttgacagttttttggactatagaccttttggcaaatctgacaaactattgaccttctcccagagatacttatttacataaacccacaaattttacatatatcattcaggagtgcatagattcctgaaggccatccagtgaccaaggttaaacacctctaatctgaatagtaataataataataattattattattactgagttacagatgatttggaaaatctctggagagactgaaaatctcttattaattaagaataaccttagaagcactcagaaaatttctgttcttgcacgttcttctcccatcttggaatatccaagagccagactagatcatccgaatcagctcttgaccagctcaagattgagaattcaggctgggtttattttgaagttactaactatgtcttttgtgatcttacaggtatctctgcattagccagattggacatatgtaaagggacatcagtatatctggatcatcagattgtgcttcaagaagaccatagggaagaacgcattttcatcttgctgcaaaagttgcaatagaagatctgaaggtttgaatgggccaatgagtatcctcatcattgaagcattctatggaggctcccataaacagctggtggatcttcttcaagaagagttaggagactgtgtcgtttatacccttcctgcaaagaaatggcattggagagcccggacatctgctttatatttctctcagaccattcccatcagtgagcattacaggaccctctttgcaagttcagtgcttaacctgaccgaactggctgcccttcggcctgaccttgggaaactgaaaaagattctgtattttcacgagaaccagttgatatatcctgtcaagaaatgtcaggagagggatttccaatatggatacaaccaaattctttcatgcctggtggctgatgtggttgtattcaactcagtttttaatatggaatcatttctcacttccatgggaaaatttatgaagctgattcctgatcacagacccaaggatctggaaagcatcatcagacccaagtgccaagttatttactttcccatcaggtttcctgatgtgagcagattcatgcccaagcacaaaacaacccatttaaagaagatgctcggccttaaaggaaatggcggtgcggttctgtccatggcccttccttttcagccagagcagagagattcagaggatttattgaagaattttaattcagagcgtgatacacactgtggccttgatactgcacgacaagaatatttgggtaactcattaagacaggaatcagacttgaaaaaatccacctcgtcagataattcaagctctcatcatggtgaaaataaacaaaacctgactgttgatccctgtgacattttgggtggaggtgataatcaccatacactgctacccatctgctggcctctcaggtgggagcatgataaagatccagaaagcttttttaaggtattaatgcatcttaaagacttaggactcaatttccacgtgtctgtacttggagaaaccttcacagatgtcccagatattttttcagaggccaaaaaggcattgggatcttctgtcttacactggggctacttacccagcaaagatgactatttccaagtactgtgcatggctgatgttgtcatctcaacagctaagcatgaattctttggagtggcaatgttggaagctgtgtactgtgggtgttacccactttgtcctaaagatttggtttatcccgaaatatttccagctgaatatctgtattctacacctgaacagctttcaaaaaggctccagaatttctgcaagagaccagatattataagaaaacatctctataagggtgaaatcgctccgttttcttgggcagccctacatggtaaattcaggtctctgcttacaacagaacctagggaagatttgtgacagatggggctaagtcacaaacttgcagcctaaggcagaatctgaagaactttccagagtgtgcccatatttacctgatcagagagaaaagaaaatctgcagaggaagctgagcctggctgcttgtcatagctgacacagagccatctgccacaaacctgtggcggcttcagatctccaatccctgccaccaccccaactcaaattaaatacagattcctagagacgttatgatggttacacatgtcctcggcatcacatgtaggagactgttcaaaaaaaatatgtggcctgttgtataaccgcactcatgtatcccatatgtggtgccacattgaatttccggttgaatccgtttttatcctttgtactggatgacatggtgcctgaattctttcttttcgccgacacgatggcagccaaactgcagcttcaaacgctcacacttggctgggtttctacctaggttgccaggttatcatcggagccttcttgtgtcctcaaagggccacgaggcctgaaaggaggatcagaatgctttgggattaattgggcagccatcgcagaattgtttgtgggcaaagggctgctttagcacttttcttttagcaaattaatgactctcaggcacagggggttttaagtgaaggtattaataagaggtctggcaggtattcccatgattcacagagttacatttgcatttaattaatcttaaagttgcaagataaacagctgtaattcggacaaacatgacaaacacagtgaagccaactatcccataaaatgaacactgacatacttgttttaatttttttcccagcgtaaaaatagaaaaatcaaaatactcctaacaaaaccagtgattttgatagaaatatttctccaatatacttgcatccacctacaaatataaccttttcaagataaatcgcttatgatttcaatagtcaaactgctgtgtttgttgatgtaaagatgttttgaatggctagatggtaaaataaattcttaataaagtacccactgcaatttttaaaaaaaaaaaa

SEQ ID NO: 274 - DNA, 4682 bp, Homo sapiens
  CDS (399)..(3083)
catcaataaccttttcagatgaaagcttatagttattcttcaataaaaattcattgactaagaagtttagagctctcttttcaagaggtttgattggctcctgaatttcaggacttgatttgtaatttttattgaagaataactataagcttacatcaataaccttttcagatgaaaacgatgatcaggattttgaattatgggatgatgtaggattaaacattccaaaacctccagacttattgcaactctaccgggattttggaaatcatcaagtaactggaaaagatcttgtagatgtggccagtggagtagaagaagatgaattagaggcccttacaccaattataagcaaccttcctccaactcttgaaactccccagcctgcagagaactccatgttagtacagaaattagaagataaaattagtttgttaaatagtgagaaatggtcattgatggagcaaatcagaagacttaaaagtgaaatggacttcctcaaaaatgaacactttgccatcccagcagtttgtgactctgttcagcctcctttggatcagttgccccacaaagactctgaggacagtggacagcatccagatgtaaatagttcagacaagggaaaaaacacagacatccatctttcaatatcagatgaagctgattccactattcctaaagagaattccccaaattcattccccaggagagaaagagaaggaatgccaccttcttctctatcaagtaaaaagacagttcattttgataaacctaataggaaattgtctcctgcattccatcaagcactactctctttttgtcgaatgtcagcagatagtcgtttaggatacgaggtgtctcgtattgcagacagtgaaaaaagcgttatgttaatgctgggacgctgcctgccacacattgttcccaatgtgctattggcaaagagagaggagttgatccccctcatattgtgtacagcatgtctacatcctgagcctaaagagcgagatcagcttctccacatacttttcaatttgatcaagaggccagatgatgagcaaaggcaaatgatactgacaggttgtgtggcatttgcgcgtcatgttggaccaacacgtgtagaagctgaacttttaccacagtgttgggaacagattaatcacaaatacccagaaagacgactgcttgtggcagaatcctgtggagcactggcaccttaccttcctaaagaaatccgtagctccttggttctttcaatgttgcaacaaatgttaatggaagataaggcagatttggtaagagaagctgttatcaaaagccttggtatcattatgggatacattgatgatccagacaaatatcatcagggttttgaattgttgctgtcagccttgggtgatccctcagaaagagtagttagtgctacacatcaagtatttttaccagcttacgctgcgtggactacagaacttggaaatttacagtctcatcttatacttacactactgaacaagattgaaaaacttctcagggaaggagaacatggactggatgaacacaaactccacatgtatctttctgccttgcagtccttgatcccatctctctttgcattagtgctacagaatgcacctttctccagcaaagccaagcttcatggtgaagtgccacagatagaagtgactaggtttcctcggcctatgtcgcctcttcaagatgtgtccactattatcggaagtcgtgagcaattggcagtgctgctgcaactttatgactaccagctagaacaagagggtacaacaggctgggagagtttactgtgggttgtcaatcaattgttgccacaacttatagaaatagttggcaaaattaatgttacttcaactgcctgtgtccatgaattctccagatttttctggcgcctttgccggacatttggcaaaatttttacaaacactaaggtaaaacctcagttccaggagattttaagactatctgaagaaaacattgattcctcagcaggaaatggggtcctcactaaagctacagttcccatttatgcaacaggagtccttacgtgttatattcagataaaggagtatttgcatatacataatgagatatcttgggaatgggacccaagtctaaacacaaaatgtgtttcatatacacattatacacatagcctgaaggaagaagaccgaaaactgttagttggattcttagaagatgtaatgacgctgctttcattatctcatgctcctcttgatagcctgaaggcttcttttgtggaattgggtgcaaacccagcctaccatgagttactattaactgttttgtggtatggtgttgtccatacttcagcactcgtgaggtgtactgctgctagaatgtttgagctgttggtgaagggggtgaatgaaactctggtagctcagagggttgttcctgctctcattactctctccagtgaccctgaaatctctgtcaggattgccacaattccagcctttggcactattatggaaacagtaattcaaagagagttgctggaaagagtgaaaatgcagttggcttctttcctggaagatcctcagtatcaagaccaacattctttgcatacagagatcataaaaacatttggtagagttggccctaacgcagaacccaggttccgagatgagtttgttataccacatttgcataagttagccttggtgaacaacttacagattgtggattctaaaagactggacattgctacgcatctttttgaagcctacagtgcactttcctgttgtttcatttcagaggatttaatggttaatcactttttacctggtctcagatgtttacggactgacatggaacatctctctccagagcatgaggttattttaagttccatgataaaagaatgtgaacaaaaagttgaaaacaagaccgtccaagagcctcaaggctcaatgtcaattgctgcaagcttagtgagtgaagatacaaagaccaagtttttgaacaaaatgggccagttgacaacatcaggtgccatgttggccaatgtatttcagagaaagaagtagaagcaggaaagaagcccccagtaaacactaagatggacctcaagccgactggttccttgtacttgaagtacttgccttttttgtttcctcagttttatgttcttgcattataattttatcctaacctccaaagatatttgcactgcttttaattactgctgtatatttgttgattttggagttacaactgtggtgatagaaaattgagttgatggtctgtaccaagtcccttgtctatgttcttgtctttcagaataatttttatataaatatatatatagtgaagaagttttttttaatttttggatgggatattcgcaaatatctgtattatacactaagctattacaatggtacttaaaataatgtaaatttgaagtcattgttataaaataataaagtggagattacttaagtatttaaattatgaaagaataatgcagactttttattgtttcttaactgactagaaagagccaccagcattactctgtgccttttggacatcagtttgtgtgttctgtaggaattgtgtgcattccattcacacagtatttctttaggatgctgtgatgatttgaattacaaatcctacagtcaatagctaaagacgaaaccttcatttcagaactctcatgaatattctttaagtgctatttaaacctccccagcacttagatgcatataatggacttacctgaggaaagacagcacataggcatggggagaggtaaccaaggtgaattttacaaactggtgtatagtagatttaaatgctcaaaaataaatgtaactgagaagagttaataattgtgagatttttcccaaattgagatacagaagaaaatatagtttgaatctgaaatttaacacttatttatgtaaaacattttatttaagatattttctaatgattttaattttagagagtaccttttcattctgtgtgttacagagaagtactgaaaagttaaggacacttgggggctacttttttccctctaaactaaaaaagacattggctgaattataactagttagttatcacctcgtcccttaaagtcagtgacctcctgtgtttgatgtatattacatagagtcttaagtcagtgtacagttccactggaatttgacagttgtctctacagtcatgcaactcgaagtagaaaagagtgctggacataggaagggggtgcttggtttgaggggttaatgtgaggcctttttgaaaaatgaatattttgataaaaagaattcttgttttagcacagttgatgcacataagtgattctcatatttgttgtataaactggtttaatacatttggaacatagttggattacattcatttcctgggaaagctagcttaccatacattcaagtttataaaacaatttgccataggcaaagccatttaaaaagttcattctgaaattatttcatttacctacagtgaaataattgtgaactaagtagtctttctgaaaactgttgggttctaggcattcctgagaaattgaaagtggctacctttcatgtcaaaaatgttgatctattataaataaaatgtttttgcatatgtttttgaaaaaaaaaaaa

SEQ ID NO: 275 - DNA, 4580 bp, Homo sapiens
  CDS (399)..(2981)
catcaataaccttttcagatgaaagcttatagttattcttcaataaaaattcattgactaagaagtttagagctctcttttcaagaggtttgattggctcctgaatttcaggacttgatttgtaatttttattgaagaataactataagcttacatcaataaccttttcagatgaaaacgatgatcaggattttgaattatgggatgatgtaggattaaacattccaaaacctccagacttattgcaactctaccgggattttggaaatcatcaagtaactggaaaagatcttgtagatgtggccagtggagtagaagaagatgaattagaggcccttacaccaattataagcaaccttcctccaactcttgaaactccccagcctgcagagaactccatgttagtacagaaattagaagataaaattagtttgttaaatagtgagaaatggtcattgatggagcaaatcagaagacttaaaagtgaaatggacttcctcaaaaatgaacactttgccatcccagcagtttgtgactctgttcagcctcctttggatcagttgccccacaaagactctgaggacagtggacagcatccagatgtaaatagttcagacaagggaaaaaacacagacatccatctttcaatatcagatgaagctgattccactattcctaaagagaattccccaaattcattccccaggagagaaagagaaggaatgccaccttcttctctatcaagtaaaaagacagttcattttgataaacctaataggaaattgtctcctgcattccatcaagcactactctctttttgtcgaatgtcagcagatagtcgtttaggatacgaggtgtctcgtattgcagacagtgaaaaaagcgttatgttaatgctgggacgctgcctgccacacattgttcccaatgtgctattggcaaagagagaggagttgatccccctcatattgtgtacagcatgtctacatcctgagcctaaagagcgagatcagcttctccacatacttttcaatttgatcaagaggccagatgatgagcaaaggcaaatgatactgacaggttgtgtggcatttgcgcgtcatgttggaccaacacgtgtagaagctgaacttttaccacagtgttgggaacagattaatcacaaatacccagaaagacgactgcttgtggcagaatcctgtggagcactggcaccttaccttcctaaagaaatccgtagctccttggttctttcaatgttgcaacaaatgttaatggaagataaggcagatttggtaagagaagctgttatcaaaagccttggtatcattatgggatacattgatgatccagacaaatatcatcagggttttgaattgttgctgtcagccttgggtgatccctcagaaagagtagttagtgctacacatcaagtatttttaccagcttacgctgcgtggactacagaacttggaaatttacagtctcatcttatacttacactactgaacaagattgaaaaacttctcagggaaggagaacatggactggatgaacacaaactccacatgtatctttctgccttgcagtccttgatcccatctctctttgcattagtgctacagaatgcacctttctccagcaaagccaagcttcatggtgaagtgccacagatagaagtgactaggtttcctcggcctatgtcgcctcttcaagatgtgtccactattatcggaagtcgtgagcaattggcagtgctgctgcaactttatgactaccagctagaacaagagggtacaacaggctgggagagtttactgtgggttgtcaatcaattgttgccacaacttatagaaatagttggcaaaattaatgttacttcaactgcctgtgtccatgaattctccagatttttctggcgcctttgccggacatttggcaaaatttttacaaacactaaggtaaaacctcagttccaggagattttaagactatctgaagaaaacattgattcctcagcaggaaatggggtcctcactaaagctacagttcccatttatgcaacaggagtccttacgtgttatattcaggaagaagaccgaaaactgttagttggattcttagaagatgtaatgacgctgctttcattatctcatgctcctcttgatagcctgaaggcttcttttgtggaattgggtgcaaacccagcctaccatgagttactattaactgttttgtggtatggtgttgtccatacttcagcactcgtgaggtgtactgctgctagaatgtttgagctgttggtgaagggggtgaatgaaactctggtagctcagagggttgttcctgctctcattactctctccagtgaccctgaaatctctgtcaggattgccacaattccagcctttggcactattatggaaacagtaattcaaagagagttgctggaaagagtgaaaatgcagttggcttctttcctggaagatcctcagtatcaagaccaacattctttgcatacagagatcataaaaacatttggtagagttggccctaacgcagaacccaggttccgagatgagtttgttataccacatttgcataagttagccttggtgaacaacttacagattgtggattctaaaagactggacattgctacgcatctttttgaagcctacagtgcactttcctgttgtttcatttcagaggatttaatggttaatcactttttacctggtctcagatgtttacggactgacatggaacatctctctccagagcatgaggttattttaagttccatgataaaagaatgtgaacaaaaagttgaaaacaagaccgtccaagagcctcaaggctcaatgtcaattgctgcaagcttagtgagtgaagatacaaagaccaagtttttgaacaaaatgggccagttgacaacatcaggtgccatgttggccaatgtatttcagagaaagaagtagaagcaggaaagaagcccccagtaaacactaagatggacctcaagccgactggttccttgtacttgaagtacttgccttttttgtttcctcagttttatgttcttgcattataattttatcctaacctccaaagatatttgcactgcttttaattactgctgtatatttgttgattttggagttacaactgtggtgatagaaaattgagttgatggtctgtaccaagtcccttgtctatgttcttgtctttcagaataatttttatataaatatatatatagtgaagaagttttttttaatttttggatgggatattcgcaaatatctgtattatacactaagctattacaatggtacttaaaataatgtaaatttgaagtcattgttataaaataataaagtggagattacttaagtatttaaattatgaaagaataatgcagactttttattgtttcttaactgactagaaagagccaccagcattactctgtgccttttggacatcagtttgtgtgttctgtaggaattgtgtgcattccattcacacagtatttctttaggatgctgtgatgatttgaattacaaatcctacagtcaatagctaaagacgaaaccttcatttcagaactctcatgaatattctttaagtgctatttaaacctccccagcacttagatgcatataatggacttacctgaggaaagacagcacataggcatggggagaggtaaccaaggtgaattttacaaactggtgtatagtagatttaaatgctcaaaaataaatgtaactgagaagagttaataattgtgagatttttcccaaattgagatacagaagaaaatatagtttgaatctgaaatttaacacttatttatgtaaaacattttatttaagatattttctaatgattttaattttagagagtaccttttcattctgtgtgttacagagaagtactgaaaagttaaggacacttgggggctacttttttccctctaaactaaaaaagacattggctgaattataactagttagttatcacctcgtcccttaaagtcagtgacctcctgtgtttgatgtatattacatagagtcttaagtcagtgtacagttccactggaatttgacagttgtctctacagtcatgcaactcgaagtagaaaagagtgctggacataggaagggggtgcttggtttgaggggttaatgtgaggcctttttgaaaaatgaatattttgataaaaagaattcttgttttagcacagttgatgcacataagtgattctcatatttgttgtataaactggtttaatacatttggaacatagttggattacattcatttcctgggaaagctagcttaccatacattcaagtttataaaacaatttgccataggcaaagccatttaaaaagttcattctgaaattatttcatttacctacagtgaaataattgtgaactaagtagtctttctgaaaactgttgggttctaggcattcctgagaaattgaaagtggctacctttcatgtcaaaaatgttgatctattataaataaaatgtttttgcatatgtttttgaaaaaaaaaaaa

SEQ ID NO: 276 - DNA, 1890 bp, Homo sapiens
  CDS (78)..(1757)
cggacgcgtgggcggacgcgtgggcgagtccggccgggcagtagaggaaattgcggtagtgaccctcgggcctcgccatgaagagccgctttagcaccattgacctccgcgccgtactcgcggagctgaatgctagcttgctaggaatgagagtaaacaatgtttatgatgtggataataagacataccttattcgtcttcaaaaaccggactttaaagctacacttttacttgaatctggcatacgaattcatacaacagaatttgagtggcctaagaatatgatgccgtctagttttgccatgaagtgccgaaaacatttgaagagtcggagattagtcagtgcaaaacagcttggtgtggatagaattgtagattttcaatttggaagtgatgaagctgcttaccatttaatcattgagctctatgatagggggaacattgttcttacagattatgagtacgtaattttaaatattctaaggtttcgaactgatgaggcagatgatgttaaatttgctgttcgtgaacgctatccacttgatcatgctagagctgctgaacctttgcttactttggaaaggttgactgaaatagtagccagcgcacctaagggtgaactactgaagagggtgcttaacccattacttccctatggaccagctctcattgaacactgtcttttagaaaatggattctcgggtaatgtcaaagtggatgaaaaacttgaaactaaagatattgaaaaagtacttgtttctctgcagaaagcagaagactatatgaaaacaacatccaacttcagtgggaagggatatatcattcagaaaagagaaataaaaccatgcttggaagcagataaaccagttgaagacatactgacgtatgaggaatttcatcctttcttgttttctcaacattcacaatgtccatatatagaatttgaatcatttgacaaggcggtggatgaattttattccaagatagaaggccagaaaattgacttaaaagctttacaacaggaaaagcaagcattgaagaaattagataatgttcgaaaggatcacgaaaacagattggaagctcttcagcaggctcaggaaatagacaaactgaaaggagagctcatagaaatgaacctacaaatagttgacagagccattcaggtagttcgaagtgctttagctaaccagatagattggacagaaattgggttaattgtgaaagaagcccaggctcaaggagaccctgttgcaagtgcaatcaaagaattaaaactacaaacaaaccatgttacaatgctgctaagaaatccatacttgttatcagaggaggaagatgatgatgttgatggtgacgtcaatgttgagaaaaatgaaactgaaccaccaaaaggaaaaaagaaaaaacaaaagaataaacagctgcagaagcctcagaaaaataagcccttacttgtagatgttgatctcagcttgtcagcatatgccaatgccaaaaagtattatgatcacaagagatatgctgctaagaaaacacaaaagactgttgaagctgctgagaaggcattcaagtcagcagaaaagaaaacaaagcaaacattaaaagaagttcagactgttacctctattcaaaaagcaagaaaagtatattggttgactgaaatagtagccagcgcacctaagggtgaactactgaagagggtgcttacccattacttccctatggaccagctctcattgaacactgtcttttagaaaatggattctcgggtaatgtcaaagtggatgaaaaacttgaaactaaagatattgaaagagtacttgtttctctgcagaaagcagaagactatatgaaaacacatccacttcagtggaagggattatcatg

SEQ ID NO: 277 - DNA, 3038 bp, Homo sapiens
  CDS (1)..(1557)
atggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccggccccacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaagaatattcctagaaagttcggaggctcactctcaacgatctgtccacgggatcataaggctctccttggattagtaaaagaaatcaacagatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagcgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcataggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtgaaaaaaaaaaaa

SEQ ID NO: 278 - DNA, 4173 bp, Homo sapiens
  CDS (1106)..(2617)
  misc_feature (1)...(4173): n = a,t,c or g
attcaagtctgagatacagataagtattgctttggaaaccgatacaaagccaccagtggatagctttaaagcaaagggggctccccctcgagatggaaaagtacctgccatcctggctggacttgaccccagggacattgtggctgtgctgaatgaagagggaggctaccatcagattggaccagcagaatactgtactgactcctttattatgtcagtgaccatagcatttgctacccagttggaacagttaattccatgtaccatgaaacttccagaaagacagcctgagtttttcttttactactctttactgggaaatgatgttacaaatgaacccttcaatgatttaatcaacccaaactttgagccagagagagcatcagttcgcatccgtagcagtgtagaaattcttcgtgtttacctggctcttcagtctaaactgcagattcacctctgctgtggagaccagtcacttggaagtacagaaatacctttaactggattacttaaaaagggcagtacagaaatcaaccagcacccagtcacagtcgaaggtgcttttacccttgaccctccaaacagagccaaacagaagcttgcacctattcctgtggagctagccccaactgtgggagtgtctgtgnctctgcagagagaaggcatagactcccagtctttaattgaattaaagacccagaatgaacatgagccagagcattcaaagaagaaagttttaacccccataaaggagaagacacttactgggccaaaatcaccaacagtgtcccctgttccatctcacaaccagtcacctccaacaaaagatgatgcaacagaaagtgaagtggaaagtttacagtatgataaggacaccaaaccaaatccaaaagccagttcttctgtacctgcttcactggcccagctagtgactacatccaatgcttcagaagtagcttcaggacagaagattgctgtaccagcaacatcacatcatttttgcttttcaatagacttaaggagtatacatgccttggagattggttttccaatcaactgtatattaaggtactcatatccattctttggaagtgcagctcctattatgactaatcctcctgtagaagttcggaaaaacatggaagtttttcttccccagtcttactgtgcatttgattttgcaactatgcctcatcagctgcaagacaccttcttaaggattccattactggttgaactatggcacaaggataaaatgagtaaagatttacttctgggaattgcgagaatccagctttctaacatcttgtcttcagaaaaaactcgttttttaggttctaatggtgaacagtgttggcgtcaaacttacagtgaaagtgtgcctgttatagcagcacaaggatcaaataacaggatagcagatctttcttacacagtgactctagaagattatggactagtaaaaatgcgtgagatttttatctctgattcatctcagggtgtatctgccgtacagcaaaagccgtcttctcttcctccagcaccttgtccttcagagatccagacagagcctcgtgaaacgttagaatacaaagcagcacttgagctagaaatgtggaaggagatgcaagaagatatatttgaaaatcagctgaagcagaaagaactggctcatatgcaggctcttgcagaggaatggaagaaaagggaccgagaaagagaatcactagtaaagaaaaaggtaataacttgtgtaaaagtggctgaatatactattctagaaggaaaacttcaaaaaactctaattgacttggagaagcgagagcagcagcttgctagtgtggaatcagagcttcaaagagaaaaaaaggaactgcaatcagaacgtcagcggaacctgcaagaactgcaggactctatccgtagggccaaagaggactgtattcaccaagtagaactagaaaggttaaaaatcaaacagctcgaagaggataaacaccgccttcagcaacagcttaatgatgctgaaaataagtataagattttggaaaaagagttccaacagttcaaggaccagcaaaacaacaaaccagaaatccgtctacagtctgaaataaatcttctcaccttggaaaaggttgaacttgaaagaaagttggaatctgcaactaagtctaaactgcattacaagcagcagtggggacgagctttgaaagaacttgccagacttaaacagagggagcaagaaagtcaaatggctcgtcttaaaaaacagcaggaagaattggaacagatgagactacgttaccttgccgctgaggaaaaagatacagtaaaaaccgagcgacaagaattgttggatataagaaatgaattgaacaggttaaggcaacaagagcaaaaacaataccaggattccacagagattgcaagtggaaaaaaggatggcccccatggcagtgtattggaagaaggtttggatgattatttgactcgcctgatagaagaaagggatactttgatgagaacgggtgtgtataatcacgaggatcgaataataagtgaactcgaccgacagatcagagagattttggcaaaaagcaatgccagtaattaataacatttggaaaagctttatagagactctaagtctaaattttaatttctttgtaaaaccctcaaaagtgaggaaaatggatgttttaaaatggtattttcaattttttataagcaaaattttgtatgttattgtatagtatttatttgatcttatttactttatgctacctctcccacactggttttatttgtaatttgcatttatatactcattttaaatgacttttcagtgtttttcatagtttataatctgatggctaactaactttcaaaacagcttttaactaagtttgttgtaggagaaatgactgcggtaatttccagttctataatgtttcatgttgagccaaaagagtatatcttgcactttaaaaacactgcgtcctattccatttgaatgtaaattcttaaaagttgagaccaattgtaaccagtttaactcattttagatgacctttttttcttataatatttgcaagtgacaagtttgaaaacaaagcaagatcagtgcagagaagccacatgacatgttgggtgacagattggtcatttatttaaataaagttaatacagattaaatttgtttcaagagctattgaattttcaaattttcagtgtatttataacttttaagaacatgaagtattagcttaatatagttttctctgttggtttcttcctcaagtttgcattgttttcttttgttaaaattagagatttctttttattttccagttatagtaatactagctgtcagcttaaaccctctgtaatagaacatggaaacagacacataaagacattagctgaaaaaatagagtgaaaatcaactattttttactcccgctaatttcaatcaatcgttttcaaaagcgcacgagattcactcattggatttatgcagtgccctgtctgtataaaaactcttaagagttcctttatatcatattcttcagagccaacatttgtcctcaaagcaacgtttcccacctccttttactgagtactgaaaaagttttagcaaagtcacagattaggttgaatttcaaaatatatgtactttaaaaagttctgatttccaaatataataaagttaaaattaagtatatactttaggaagttaccaataacttccatcaaagcagagtaggatatatggtaacattaattttcggtcatttcaaatgaggtatatttcttattagggaaattaaagtccctatatttattatatattttttccttattaacagagtattaatctagtaaaaaataacccagcagtaaataataaagaaattactgaatgagaggataatgaatctgaatcatagcaggaatttgcaatattaattatggttagctatttttctctcattgatttttgtgccacttgaatggaacagaagcaagccttatgttttggaaggtctgcggtaaaatgctgtgactgtttactttcaattgcattgtgtgttgcctgtgactgctttcaaacgctagagggggcctctgatttaaagaaataaaaaggacttttctaaaaaaaaaaaa

SEQ ID NO: 279 - DNA, 2632 bp, Homo sapiens
  CDS (404)..(2242)
atgaatatagtgacaaccagtcttcaggtaggcttcggaggcgagcgaagggcgggaccaaggccagagcccgacagttacgccactcacacttgcggaagagttaacgggacagtggtgcaggccaatcgcaaccagtcctctggaggcagggagactggggtggagacttcggagactgcagttgcagttgttccgtgtaggctgttgttgactctcgtatgaaagcccacgcgatccaagtgccctgcaggttttggtccagggaaaagttggtctctgcagatgactgtaaatgactacctggaggtcgattaaagtgcggtactgcgggattcagccgatttccttcttcctctgactgcccggaaatatcagccaaaggccagcgttctaaggacatatggaattggctatggataattcatatgctttcaatcaacgaagcacatgtaatggaattccatctgagaagaaaaacaacttccttgtatcagaagatcatggacaaaaaatcttaagtgtactacagaattttagagaacaaaatgtcttttatgatttcaaaataattatgaaagatgaaataatcccgtgtcatcgttgtgtgttagcagcatgcagtgactttttcagggctatgtttgaagtaaacatgaaagaaagagatgatggaagtgttaccattactaatttgtcctccaaggcagtaaaagcatttctcgattatgcctatactggaaaaacaaaaataacagatgataatgtggaaatgttcttccagttgtcatcatttcttcaagtttccttcctatccaaagcttgcagtgactttttaataaaaagtattaatcttgtcaattgtttacagttattatctatatcagatagctatggctccaccagtttgtttgatcatgcattacactttgtacaacatcacttttctttattatttaaatccagtgatttcttagagatgaattttggagtactacagaaatgtctggaatcagatgaattaaatgttcctgaagaagaaatggtactgaaagttgtccttagttggactaaacataacttagaatcaaggcaaaagtatctgcctcatttgattgaaaaagtgagattacatcagttatctgaggagacacttcaggactgtctgttcaatgaagagagtttactcaaaagcacaaactgttttgacataatcatggatgcaattaagtgtgtgcaaggttctggtggactcttccctgatgctcgaccatccacaactgagaaatacatattcattcacaaaactgaggaaaatggagaaaatcaatatacattttgctataacattaaatctgattcatggaaaatactgccgcaatcacacctgattgatttgccaggatctagtctttcgagttacggagagaaaatattcttgacaggtggttgcaaagggaaatgttgtcgaacggttcgactgcatattgccgagtcatatcatgatgccactgatcaaacctggtgctactgtccagtgaaaaatgatttcttcttggtatcaactatgaaaacaccaagaaccatgcatacatcagttatggctctcgatagattatttgtcataggtggaaaaactagaggatcccgggacattaaaagtctcttagatgttgaatcttacaatcctctttccaaagaatggatatctgttagcccattacccagaggcatatactatccagaagcaagcacatgccaaaatgtaatttatgttcttggatcagaggtagagattacagatgcttttaacccatcacttgattgcttttttaaatacaatgctacaactgatcagtggtctgaactagtagcagagtttgggcaattttttcatgcaacattaattaaagctgtaccagtaaactgtacactgtatatatgtgacctttccacctataaggtttatagtttttgtccagacacttgtgtttggaaaggcgaaggatcttttgagtgtgcaggctttaatgcaggtgcaattggaattgaagataaaatttatatattaggtggtgattatgcaccagatgaaatcacagatgaagtgcaggtctaccacagcaacaggtctgaatgggaagaagtttcaccaatgcctagagccttaacagaattttactgccaggtgattcagtttaataaatacagagacccatggttttctaatctatgtgcttgaacattctaaaacgagtccagttctagtaacctaaagtaaatttgttaaccaaaatgataggtaaaaagatctatacatcttaatgaaataaaacattcctgcttttagttattatgtatgtacaccatatatgaataaacagtttccaaaaacttaaaatacaaaatatattttaccaaaaattatactgaatataatttaaccttggggaatccagaatacttagtattttcacatgaaactacaaatcatagactctgacactttgatttttaaagtactctgtccataaaagatttgtactgtttagatgggagaaacctctagagagagtaaaaatgaattacactgtatcttatatgaagtaaaaaataaatcagaggtgagaat

SEQ ID NO: 280 - DNA, 2489 bp, Homo sapiens
  CDS (516)..(2279)
cttttgctatcattaaactcctcctttaaagacagtggagaggctgagagaggagcatgtatttttaagagactgttatttttagaacagtgtttttccagggggaaaaacgtgagtgattctcccttttttacaacacacaaggggtccctcagaccctgaggccaccaggaaccaaagtggtgagagaattcttggcaaaaattttacatatttctaagatttgggagggcaaagtgactgaggtggctaattctcaccttagcactaggtgaagaccccatgggtggaggctgtctgggttgtcttgggtcctatcaaagaggaatgactggacaaacccacccaccagagtcggtgggccactgaatgcccagaggaagcactggggcagcagctggagaagaggctatgcccatgagaagggaagtgtatctggaggttccaagcagcaggttctcttggaaggagttggtgatgttcagagatgtggctatagatgtctctcaggaggaatgggaatgcctgaacccagcgcagaggaatttgtacaaggagaagaaaactggaaagctgaagactttttagtgaaattcaaggaacaccaagagaagtattctagatcagttgtaagcatcaaccacaaaaaactggtgaaggagaagagtaaaatatatgaaaagacatttactctaggcaaaaaccctgtgaattcaaaaaatctacctcctgaatatgatactcatggaaggattttgaaaaatgtttcagaattaatcatcagtaatctaaatcctgcaagaaagagacttagtgagtataatggatatgggaaatcactcctgagtactaaacaagagactactcatcctgaagtcaaatcccataatcaaagtgccagagctttcagtcataatgaagttcttatgcagtatcagaaaacggaaactccagcacagtcatttggatataatgactgtgagaaatcattccttcaaaggggaggcctgattacacatagtagaccttacaaaggagaaaacccatctgtatataataaaaaaagaagagcaaccaatattgaaaaaaaacatacatgcaatgaatgtgggaaatctttctgcaggaaatcagtattgattctgcatcagggaattcactcagaagaaaaaccctatcaatgtcatcaatgtggaaatgcatttagaaggaaatcatatctcattgatcatcagaggactcacacaggagagaaaccctttgtttgcaatgaatgtggtaagtccttccgcctcaagacagccctcactgatcatcagagaacacacacaggggagaaatcgtatgaatgtctgcaatgtaggaatgccttcagattgaagtcacacctcattcgtcatcagagaactcacacgggagagaaaccatatgagtgtaatgactgtgggaagtccttccgccagaagacaacactctctctacatcagagaatccatacaggtgagaaaccctatatttgtaaagaatgtgggaagtcctttcaccagaaggcaaatcttactgtacatcagagaactcatacaggggaaaagccctatatttgtaatgaatgtgggaaatccttctcccagaagacaacccttgctcttcatgagaaaactcataatgaggagaaaccctatatttgtagtgaatgtggaaagtccttccgccagaagacaacccttgtagcacatcagagaacacatacaggggagaaatcttatgaatgtcctcactgtgggaaggcctttagaatgaagtcatacctcattgatcatcaccgaactcacacaggagagaaaccatatgaatgtaatgaatgtggtaaatcattcagtcaaaagacaaatctcaatctacatcagagaattcatacaggggagaaaccctatgtttgtaatgaatgtgggaagtcctttcgccagaaagcaaccctcactgtacatcagaaaatacataccggccagaaatcctatgaatgtcctcagtgtgggaaagcctttagcaggaagtcatatctcattcatcatcaaagaactcatacgggagagaaaccatataaatgtagtgaatgtggaaagtgcttccgccagaagacaaatcttattgtacatcagagaactcacacaggtgagaaaccctatgtttgtaatgagtgtggtaagtctttcagttataagagaaacctcattgtccatcaaagaactcacaagggagaaaacattgaaatgcaataaatgatgtggtttcttatatgaattctttacaagctgttgtaaacatttagttttaaaaagaaaagcatgctgaaacatgttaatgtaattttaaatcacaagtctaataattattaaagtaccatacggaataactgtctactgtttactagcatataaaataagtatgatcattattattgaactctatcagctatgaagctaaatttt

SEQ ID NO: 281 - DNA, 3956 bp, Homo sapiens
  CDS (311)..(1945)
tttcgtgcactggcgaccctagcgggtgagaggcccttcagggccgcggcgggttgagcgcaccatcacatctaagccatcagcaagtttgttggttttaatctccaaaatacgtcttgattttgtctgactctttgccaccaccctgatctaagcccttatcatctgcttgaatcactaacttgtctccacttgcagtttttaaaagagttgcttccatttgactttttctgtctgctgtaccagcatatgagtttcaggaggggtcattgatgcagtcattctcagtctcctcggagggagtctgaagatgcttaaagagcatccagagatggcggaagctcctcagcagcagttgggtattcctgtggtgaaactggagaaagagttgccatggggcagaggaagggaggaccctagtccagagacttttcggctgaggtttcggcagttccgctaccaggaggcagctggaccccaggaagctcttagggagctccaggagctctgtcgtcggtggctgaggcccgagttgcacaccaaggagcagatcctggagctgctggtgctggagcagttcctcactatcctgccccgcgagttctacgcctggatccgggagcatggcccagagagtggcaaggccctggccgccatggtggaggacctgacagaaagagcactggaggccaaggcggttccatgccacaggcagggagagcaggaggaaacagcactttgcagaggcgcttgggagccaggcatccagctggggccagtggaggtcaagcctgaatgggggatgccccctggggaaggagttcaaggtccagacccaggtaccgaggagcagctcagtcaggaccctggagatgagacacgggccttccaggagcaagcactacctgttctgcaggcgggtcctggcctccccgcagtgaatcccagagaccaagagatggcagctgggttctttactgctggatcgcaggggttggggccatttaaagatatggccctggccttccctgaggaggagtggaggcatgtgaccccagcccagatagactgctttggggagtatgtggaaccgcaggactgcagggtctctccaggcggtgggagcaaggaaaaggaggcaaaacccccacaggaagacctgaaaggggcgctggtggcactgacatcagagaggtttggggaagcctctctccagggccctgggctcggaagggtctgtgagcaggagcctggtggccctgcaggcagtgcgcctgggcttcctcctccccagcacggtgccatccccctgcctgacgaagtcaaaacccacagctccttctggaagcctttccagtgccctgagtgtgggaaaggattcagtcggagctccaatctcgtcaggcaccagcgaacccacgaagagaagtcttatggctgtgtggagtgtgggaagggctttaccctgagagaatacctgatgaagcaccagagaacccacctgggaaagaggccctacgtgtgcagcgagtgctggaaaaccttcagccagagacaccacctggaggtgcaccagcgcagccacactggggagaagccctacaagtgcggggactgctggaagagcttcagccgcaggcagcacctgcaggtgcaccggaggacgcacaccggggagaagccctacacctgcgagtgtggcaagagcttcagcaggaatgccaatctggcggtgcaccggcgtgcccacactggcgagaagccatatgggtgccaggtgtgcgggaagcggttcagcaaaggggagcggctggtccgacaccagagaatccatacaggggagaagccctaccactgtcctgcctgcgggcgaagcttcaaccagaggtccatcctcaaccggcaccagaagacccagcaccgccaggagccgctggtgcagtgagcatagcaggtggcaggcagcaccatcattcatctttctcactgcagggccttgcggggtgcaaggtgatggctgcaggaaagcactggtcccatcgccttcccacccattcgccaacgcgggaaaggcaaggcctggcttacttagagcttccagagagcatagctgcttccatctcttacccaagtggtgctaaacaatttttcttccaatgtttgagggaagcagtctcctgcggttcagttcaggctgagattttctccttcagtggactgtctgtgtccccctgccgaacaaagctgggagtaaaggcaaaaccttgacacgtgttggtagctgggacctcatcttcctgagggctctgtcttgcctgcagggtcatagctcagactcttcccccaccccctctcttttccattgaacaaacatttattgaacatcctctgagcacctggccgtgggaatgccgtggtgaatgagagactagacgtgatgcctctgggggttgtgcgttggggatgcatgcgacagcccatgacccgaggcattctcagggtatctgtgctgtgtgcccgtgagaacatcttcccatgaccactcctgccctcctgccccgtgctggatcttccctccccagctgggatctgctcccaggcaactgtgtgaattttacattatttggagcctcatctgtgtcaggctataacattctatcctcatctgtaaaacttccccgtccattattccttgcactataacaactgtcaacacaccaactattaggaagttagtattttgctattgatcactgaataaacatcagagtattttaaaaaacagttctctagaaagaactgttataattaaaatgagtctgaaagatgaactctagtattaatgccctatatttgatggcactttatagttcataaaattaatttcaccccattctcattggacccatttcccaagtatttattgaggccctgtaacaaacatgtcaggaactcttctgggtgcttgagacacatccatgaataaaatagggggagaagctgttgacctcgtagagcttatgtctcgtggatgtacctgatcttcagaacccgtggatattcctgcaaatcctctgggcctgtattcattgctttgtcagcatcttgccctgaaatgcatttgtcacctacctcttgttactaaatggtctctgccctccagacccttgtcatccaaggcactaggggtcctggacacccactggggatgatgagctggtagcgacctgttttgcatgagtgccaagtcaggaaaaataaagatatttgtaggcattaaaaaaaaatacatttctttaaaaatgagaagatgcaatatttgtaaactgttgaagcttccttattgtgccatcacttaagggtttcatttctgtttaacagttctggaagctgcataactagcgtggactgactgctgtgtcattgtgctgtgcctttgaaccctggctgagtgagtgagtttgtcctttgttgatagtgtcctatacattgcaaaatgtggttagtcttctgagtgcctcttaataccagattcttttactgagcattttctttacttcgcattatctccattgtaccactaacggtaacactggctacctgactaaccacccacagctgtaattactcaggcccactttgaaacgtggcttaaattcaccgtgccctatagttacgggcagcatggctgtctactcttgggcttcagcacaatgcccgcttccggtgagtctttccgtggcgtcacttaagcttgtgcccagcggaggcctgccctgactggggtcgctaattcgtgtctggagatgttccccacgggggctgcggttgtccctttgcaagccctggcgtccacattgcaacatccagccttttacccccccgtagtatcaaccccgcttatccgcggctacccacagtcgcccagggcgcctcctgcctccagtccttcccgg

SEQ ID NO: 282 - DNA, 1972 bp, Homo sapiens
  CDS (1)..(1458)
atgcgggagagaatatttgaccttagatttgtccgcctgcatctttctcctgacgccaacctcagttcctcctctgactgcctctctccatctgtattgcaaaacaccaaactctctgccaaagaacacatcctaaaggtcccgcttctaatcccatcatctctccataccgccctctgccggcctttcctctggtcgcccggattgcgagccgcttccggacgctccggaagcgaacctttcttttccggattgggcatcccggcatctgcacgtggttatgctgccggagtttgggccgccactgtaggaaaagtaacttcagctgcagccccaaagcgagtgagccgagccggagccatggagggccagagcgtggaggagctgctcgcaaaggcagagcaggacgaggcagagaagttgcaacgcatcacggtgcacaaggagctggagctgcagtttgacctgggcaacctgctggcgtcggaccggaaccccccgaccgggctgcggtgcgccggacccacgccggaggccgagctacaggccctggcgcgggacaacacgcaactgctcatcaaccagctgtggcagctgcccacggagcgcgtggaagaggcgatagtggcgcggctgccggagcccaccacacgcctgccgcgagagaagcctctgccccgaccgcggccacttacacgctggcagcagttcgcgcgcctcaagggcatccgtcccaagaagaagaccaacctggtgtgggacgaggtgagtggccagtggcggcggcgctggggctaccagcgcgcccgggacgacaccaaagaatggctgattgaggtgcccggcaatgccgaccccttggaggaccagttcgccaagcggattcaggccaagaaggaaagggtggccaagaacgagctgaaccggctgcgtaacctggcccgcgcgcacaagatgcagctgcccagcgcggccggcttgcaccctaccggacaccagagtaaggaggagctgggccgcgccatgcaagtggccaaggtctccaccgcctctgtggggcgctttcaggagcgcctccccaaggagaaggtgccccggggctccggcaagaaaaggaagtttcaaccccttttcggggactttgcagccgagaaaaagaaccagttggagctgcttcgtgtcatgaacagcaagaagcctcagctggatgtgactagggccaccaataagcagatgagggaggaggaccaggaggaggccgccaagaggaggaaaatgagccagaagggcaagagaaagggaggccggcaggggcctgggggcaagaggaaagggggcccgcccagccagggagggaagaggaaagggggcttgggaggcaagatgaattctgggccgcctggcttgggtggcaagagaaaaggaggacagcgcccaggaggaaagaggaggaagtaatagtttctaactgtcggacccgtctgtaaaccaaggactatgaatactaaatgttaagttctaggcaattatacggggactcagaaggacctggccgctgccttcattgagtttaaagggacaggattgcccttccgtcaagaaagtatgtaagtgttggactgcacaaattaatgtttttcccacaaccgagactttggagattaagaacttatttgaggatttaagaattagggaaataatttggtggaaaccgggaatgagttctattcttaaacagcctttttttttctttttaatgttggatatacggcgaggtagagttggccatatttcagagacttagattgacgtatatgtttctgcattatttttacaacaagtttgtgtatcagagcgggagtgcgggggagggaaagaaaacaaacagtttcagaattgaataggcaagtgactgttttaaagattaagtaataaagatgtcttatctagtgtgacttttaaaaaaaaaaaa

SEQ ID NO: 283 - DNA, 2229 bp, Homo sapiens
  CDS (374)..(841)
ctacattttagaaaggcagtaggaagaagtttatacaagtcaaaagaattgttttaaagggaaagtaaaggaaaatatctgttagtggcttattcgaggtgtgtcagttgattaatttcctttctctcaaccataagttttctttgctctgttatatattattagggtttcctagttactctaaaagaccttctgttggaacaatttgtttttctcaagcacaacccatctccaacttgtctgtatttctgagactttcaagaaatgttggttatcattttaattgattttctgctaggatggaaaaaaagagccaagttcatgtacctgtttgaaggggcccaaactgtcagaaatagggacgattgcctggatgataacgctctgcgatgccctccacaatttcatcgatggcctggcgattggggcttcctgcaccttgtctctccttcagggactcagtacttccatagcaatcctatgtgaggagtttccccacgagttaggagactttgtgatcctactcaatgcagggatgagcactcgacaagccttgctattcaacttcctttctgcatgttcctgctatgttgggctagcttttggcattttggtgggcaacaatttcgctccaaatattatatttgcacttgctggaggcatgttcctctatatttctctggcagatatgtttccagagatgaatgatatgctgagagaaaaggtaactggaagaaaaaccgatttcaccttcttcatgattcagaatgctggaatgttaactggattcacagccattctactcattaccttgtatgcaggagaaatcgaattggagtaatagaaaatggaagatggtgttgttaataaaggcatttaatagataaaaacatctccaaaaaggattttgaagctgatcctatttagttaaaaagataattttgctttcaactgtaggtccagaaaactaattattggcatcagtctgtgaaatagtccattatttgttgttaaaaatgcttcaaaaggttttcagtgtcagtctgagatgcctggtatataggagcctttgggaaatacctatttttcagtattccatgcatattggatatcaccatgaagcaagagacatgcattctataatcatgtagacactcagactcaggggaaaatacaagttatatcctgaaagcctttaaaactctatggtaggatcaaagattcaaatggtttcagagaggttttatttcaattaatttgttctagtgctttcaagagcaagtacatcaaaatgtagaaggtaaaatgtatgcaacactaatataaattattccaagtctttaaggagccaaagaaaaaaaagatttctcacagctttttgttctgttttgtatttcaattaggaacttgcagtattattttgaaaaccattctaaaataataggagttaggaaataaataaagttttgctagccctgctaagttcaggcttagaggcttatcgctaagtgtaaacttcaccagattccacgaaaagctggatagctttttttctgacttatgttgtggttgcacccctcacaaatggcagaacagtatgtaaagctggtaacacctcggtttcagtgcaccatgtgtttgctttgtgaaggtgaagaatatgttggtttagagaaagaaattggatgtaattttatgcaatttacttttaaagacaaacataactatttagcagagaatattttaataaatgcaaaacaacagctggactgctgtacatcaaggacagattaactggaaaacatatgttccttatgtgtgattgagagccattcagaaaagacttcctttgtgttcagcctatacttttccatatggtataccttgaaaaaaattagcacaccatggttatttttctaccttttataaaagacagagcctgtttactcatttagaagatagagaaaattggtctaaaattgaacatcctagattcacactcccaagtcacttaaggtgatttgatggtgaggaaaatgattgacaaagcccaacaatgatctcaggaattacattttccaacagaccaaaaaatgttttcatgtagcagcaatgcagatttggtgaatatttaatatatattttagtatgtatttcactttatgactgacaattaaaaaatattgtttggccaaatagtaaacacccttttgaaaccaaaaaaaaaaa

SEQ ID NO: 284 - DNA, 2654 bp, Homo sapiens
  CDS (167)..(2377)
tggtgttttcaggactcggttggatgcctcagccatagtaagtgggaaagtgagcgagcaagcgagctactagcgaccggaggaaagtgaacagggggagaagggaacagcaagaacaggactccagagcgataaacactcgctggagagggagacgcaggaagcgatgaaagagatgtctgcaaacaccgtgctggacagccagcgtcaacaaaagcattatggaattacctccccaattagtttggcatctcctaaagaaattgatcatatttacacacagaaattaattgacgccatgaaaccatttggagtgtttgaagatgaggaagaattgaaccacaggctggtggttcttggtaaattgaacaatttagtaaaagaatggatttctgatgtcagcgagagtaagaacctcccaccttctgttgtggctactgttggtggtaaaattttcacatttggatcctataggcttggagtacacaccaaaggagctgacattgatgcactttgtgtagctccaagacatgtggaaagatctgatttttttcagtctttttttgaaaaattgaaacatcaagatggcattagaaacttaagagctgtagaagatgcctttgtacctgttataaaatttgaatttgatggtattgaaattgatctagtctttgcaagactggcaatacaaaccatatcagataatttagatctaagagacgactctcgcctgagaagccttgatataaggtgtattcgcagcttaaatggttgtagagttactgatgaaattttgcatttagtgccaaataaagaaacttttagactcaccctaagagctgtcaaattatgggcaaaacgacgtggtatttattccaacatgctaggattccttggtggtgtctcctgggcaatgctagttgcaagaacttgccaattgtatccaaatgcagcagcatctactttagttcataagttctttttagttttttccaagtgggaatggccaaatcctgtgctgctgaagcaaccagaagaaagcaatttgaatttgcctgtctgggatcctcgggtaaatccatcagataggtatcatctcatgcccataatcacccctgcctacccacaacagaattctacgtataatgtgtccacatcaactcgaacagtaatggtagaagaatttaaacaaggtcttgcagtcacagatgaaattcttcaaggaaagtcagattggtccaaactacttgagccaccgaatttctttcaaaagtatagacattatatagtattgactgccagcgcatcaacagaagaaaaccatctagagtgggttggattagtagaatctaaaatccgtgtacttgttggaaacttggaacggaatgaatttattactcttgcccatgtgaatccccagtcattcccagggaataaggaacatcataaagacaacaattacgtatcaatgtggttccttgggataatttttcggagagtagaaaatgcagaaagtgtcaacatagacttgacatatgatatacagtcatttactgatacagtgtacagacaggcaaacaatataaatatgctaaaggagggaatgaaaattgaagcaactcatgtaaagaaaaaacaacttcaccactaccttcctgcagaaattcttcaaaagaagaaaaagcaaagtctctctgatgtcaatcgaagctcgggcggacttcaatccaaaagattgtctctggatagcagttgtctggatagctccagagacactgataatggaacaccttttaattctccagcgtccaagtctgatagcccttctgtaggagaaacagaaaggaatagtgctgagcctgctgctgtaattgtggagaagccactgagtgtaccaccagcccaaggactttccattccagtgattggcgcaaaagttgactctacagtaaaaactgtatcaccccccactgtgtgtaccattcctaccgtagtaggacgaaatgtcattcctagaatcacaacacctcacaaccctgcccagggacaaccgcatctgaatggaatgtcaaatataactaagactgttacacctaagagatcccattccccatccatagatgggactcctaagaggttgaaagacgtagaaaagtttattcgacttgaatcaacatttaaggacccccgcactgctgaagaaaaaaaaagagaatcacaggatgccattggaggagaatctatgcctattccaactattgatacatcacgcaaaaagagactacccagtaaagaactaccagattcatcatctccagttccagcaaacaacatccgtgtcatcaaaaattccattcgactgacccttaatcggtaaaagcagtgcctcctcacttaagtgaacaagcaatcatttagtggcatagatgcagccacttgttttttaaatagaagtggctgtcatacgtgaaataaggtgaaagtgacagccttcagtctaataaccttgaagtggtttttgaactgtcaaactttgacctgtagatgctgtagcattctctcactgattgctacatacacttctctgaggatcacctgctgtcaaattgccatctacagtattacagctttgcatttgggggttttactgcctt

SEQ ID NO: 285 - DNA, 2917 bp, Homo sapiens
  CDS (114)..(1367)
aacaacaatctttaggtcatgcagacctccctgatggcatccagaagtttcaccgaggggtgcagacagtgttgatcattggggatgtcacctcccggatacccacctcactcatgaaagcccccagttatgtgagagttcaagtcagtcggtttgtccagaagaaggccatggacagaacggagactaggttccgtaagaggggacagattacgggaaagatcacgaccagccgtcaaccgcacccccagaatgagcagagtccccagcggagcacctcggggtaccccctccaggaggtggtggatgatgaaatgttgggaccatcagcccctggggtagatcccagccccccatgtaggtcccttggctggaaaaggaagagggagtggtcagatgaatctgaggaggagccggagaaggagctcgcccctgagcctgaggagacctgggtagtggagatgctgtgtgggctcaagatgaagctgaagcaacagcgagtgtcacccatcctccctgagcaccacaaggacttcaacagtcagcttgcccctggggtagatcccagccccccgcataggtccttttgctggaaaaggaagatggagtggtgggacgaatctgaggagtcgttggaggaggagccacggaaggtgctcgcccctgagcctgaggagatctgggtggcggagatgctgtgtggcctcaagatgaagctgaagcgacggcgagtgtcgctcgtgctccctgagcaccacgaggccttcaacaggctgcttgaggatcctgtcattaaaagattcttggcctgggacaaagatctgagggtgtcggacaagagccctcctgaggaaggcatggctctctgcagggtgggtgccagtcctgagctaggaacggtcccttaccttcctctctgggaagctgacctcagccggaggtctctcctggtggtgcccctgagcagcaacctgattcctgtcctcagctacctggccaatgacatggaggaggacgacgaggactccaaacaaaacatcttccacttcctgtatgggaagaaccgctctcgcatacccttgctccgtaagcgtcggttccagttataccgttccatgaacccgagggccaggaagaaccgctctcacatacccttggtccgtaagcgtcggttccagttacgccgttgcatgaacccgagggccaggaagaaccgctctcagatagtcctgttccagaaacgtcggttccacttcttctgttccatgagctgcagggcttgggtttccccagaggagttggaggagatccaggcttatgacccagagcactgggtgtgggcgcgagatcgcgctcgcctttcctagagctccagggaccatggaggcctgaggtcatcggcctgagagaagaacaccggacccaggggagatgtggattttcagcaggaactttattccaatgctaatggcagacaccaggaaggaggagaggaaccatttgtgcagatcatctagaagaacctggaccattcttgatggagctgaatacagtgatcacgttgtcctcctaggagcaggggtggggggagggggatggggtccttctaggagtccttggagaaaagtaagaaaccaggagtgtttccagttccaccctttcctggggcaccaccaccctttttatattgctgaattccaacctccctggggcggaacctggaggtcctgtttcttacggacttggttgccacagtccaggagcatttgaaggcacaatgcaggggctcagattggcacagaattcttttgtgaaatatcagtgccacagattgtaacagatagcttcatgcacactctgcattttattggtttgtttggaaaatgttggccattgaattattcatagatttatttcaaatagtttggaaattgttgtacttttgaaaacatgctgttcctgtagttttttgatgagagttatagttgttatatatacataaagataattttcttttcatttttaagagacaattctttttatcctaaatattttattatctttaaatttgtttctgtattattatatgtgctcctgaagcgagcactctttttatctatgatacttccataaaaatctcttctatttatagctattggtagttccccaccagaaaaaaacataattctggtgatagaaatttttatttgctgtttaggtttgtgactgaattgtgagaattcagttgtgatttttaacatgtctcagatatatatactaacacgtctaatacatactatctaatttattggtttattttgaaaaacatgggtatagaattatttaaatattattttatttattgaaatatttattaaatatatttatttatttaaatattattattactttaaatattattttaaatattttggaaatactggtatttttgaatagatgctgtttctataaagctgtgtgatgggtgttataactgttgtatacacatacatataattttgttttcctttttaagagaggattcttttcatcctaaatcttttacctttcaatctttgtatctattattacacgtgctgctgaagggagcatggtttttatctatgatacttagttaacatatatattacatttatagctatgtagtagttcccctaaattcttgtaaaaataaatttttatttgatatttagtgtatgtttgaaatgtgagaattcagatggaattttttatcttgttttggcatgtttgtatgttactttaaagaggatgtgtgttctaaaggaggacatgagctgtgtgttttcaagagaacagtgcagtgcatctcttggggaaacataataaagatgaacttttctcaccttcacagtgagtgtgatccaaaaaaaaaaaa

SEQ ID NO: 286 - DNA, 6745 bp, Homo sapiens
  CDS (1)..(6147)
atgtccaagcaagagccttttccaaaccctgaagccccaagagactcaccatctggggaaagtgtggccttttgttctcctactttagaaaggcgatacttccagctacacaggccttatttctgttccttgcttcttcccttggggcacttgttgctctacagaggctacccctctgcctggaaagctctctctcagacccttctgccacgaccctttggcctcatccttcatccttcattcttccagccctatgtcatctcagagaaatcttcactggtggtgcctcagcccagcaaacttcagaagacaaagagggatatcagatggcttcagggagtgactggtgaatggtttgaagaaattcaaagaaaaaagttttgcaatgaaacagatgttagccaaatgttaaaacaaccacttacatacaggctaagtaaggagatggcaaaaaatgatccgatagaattacctacatcaagatctaaaaatgtaactaatcaaaaaaagccgacacctttttcttcccggatgagcttcagatcgtcatttgcttccctgttctcattcaggaaatctggaaaggagacttcaaagcttccatcactgggacagaaaggatgtgatggccatgcaggacctcctatgcctgtgaggggagctgctgtgcaggcaaaaatatacaattcacctctggaaaatcatctagttgacagtacatttgtcccaaagccagcagtcatgagggaggagagtggcatgcctccaccgtgggatgcttcactgctggagaatgagtttttccaagttttagatgacttggatagcaaattggctcaggaacagtctgcaagctcagtgaataccagaacacccctcaactatggatcaagaacacagttcggtcacttttattccagtggtaacagacatggtaatatcacagaaaggcacaaaaaacactataatgaaacttccaatatgtctatctatgacatcctaagaccaggaactcctagggaaggttttaaaaccttttctcctaggacaagcacaatttatgatatgtataggacaagggagcccagagtctttaaagaagattatgtgcaaaagaatacttttggcagtacttcgctgtgttttgacagcaggcaacggtcggccttaccagccacagggcatttcacagcaagaagcttacattttccagccacaactcagagcaagagtgggtttataccaccaaggcaccagcagagtccaaagagaactcctttatcatccatcatatggaacagatcagattcctctagagacagggagaaccaggaagagttcctgagggcaccatcaccaatggaaattgatcccgctgacaagtatgtgtatcccaggggttttcaggagaataagagatatgaatcgtaccattcacagaatgtttaccaacgtgttagtttaaatgctcccatggagaatgcaatgagtcccgacacttttgagaactcagagaacatgccattctaccatcaaagcaacacatttaccagatctttcttcagcaatacctttggacgaagcggagaacagaggagatttggacaaggtcctttttggggccaagagaaaggacattctttctggtctgactttcatcgaagcaggaaatcattcagttcttctgacagagactttgaaatgatttccatggaagcaaatagtgtatcagccattcatggccataatgtttcttctgaacactgggaatcattttcttctggttatggaacagatgtttccagaggccaagaagagccacatccttggcagtttgattttcagagatccacactggatagcatggtggtatcacatggtaatgagacccagttgactcctcattttggcacaccaaatgtttgctccatgactggttcaagctatcacgtcaaatctagtgagttggtaagtcaacaggacagttctcctgtagaagtacatataaacaaagaagcttcctcatttggaattgctcagactctagcatcctcattcaaaacttccttttcccagatttctgatgacagaaggaatcctcagagtcccaacttgcagaatcccacagtcactttgcagaaaatttttccaaataagcctgcctctcatccaatgagaagccatacagaagtcactgtgaccaacagcaattcagttgactctctgcctcttgccaaaagccagcccaatatcttggtcacagaagtaaataatgagaaagacttaaatgaatctatttcagaagaagacaaacagctaagcaagatggaccagacaaacaaggcaggtgaaataccccaacctgtttcacagacagggatctcaaactctttacctgattttcaaaatcccttatcccaggactcagccaagagcaacgggtttggttttaatgcatctaccataataagttcaaaaaagtcacccagagtcttttccaggaaagatacctccaaaatgtatataccgcacacagataaatccaatgacattaaacaagataagaggtttactgaaaacagaaaacttggctcaacagcttcccttcctttcattcaggaacacagaacaccaccatctttccccaggacagaccaaggttgtcaccaggaattaactgtaaataatgaagatatttcaagaattattacaaataaccactggagctctgcactgactgatactcaaaatgcacaatactcaaaatgcaagttaactcctggccacaagacctcgtgtgattctttagatctgtcatcagctgcactaccagattcctcaccatcaaagaattcttcccttgatgctcctgtggttccatctactacagtgttctccaggagaagtccttcagacaaagatccatcgctaggagaaagagaagaaaaagacaatgctgggaagaaccaaaagaatcagtttattgtaagccactcagaaaaccaagagagaaatgatagtcctgtgcctacacatgatgaagtggttgatgtcaaatgccattcacactctccttttaggaatgaaagaggaaaaggaaaaataaggcatcatatatcctgtattgaaaagttaagcaaaacagaaagtatatcagtacccaccagtgatcacaggagcctcattgaagcaaatcaaagcaattccaaagtttctgaacttgacacaatttattgtaccttgccaagaaaatcaagcagttttctcatacatggcaggcagtcaggaagtaaaataatggctgcttcattgaggaatgggccacctcccttccaaatcaaaaataatgtggaagatgcaatggggaactatatgttaaacaaatttagtcccagttctcctgagtcagcgaatgaatgttccaaagtcctttcagactcagccctggaagcacctgaagccacagagagaatgacaaatgtaaaaagcagtggatctacttccgttagaaaaggaccacttccattcctcatcaacagggctatgtcatgtccctcaggggagccacatgcctcaactggaagagaaggaagaaaaaagccattgacctcaggcatggatgcttctgagctaacaccaagggcttgggagagaatcattagccctgtggaaagtgactcatctgttagagattgttctttaaccaaaagacaacaccaaaaggaaaacttccaagaatacactgagaaagagggtaaaatggctgcctccaggagaagtgtatttgctctttcaaatgaagaccctttacctttttgctcagacttgtcaggaaaagaacgtgggaaaacattacataaagttaagacgactagtacgttttctgtttctggtgatgaagataatgtaaaatgtctggaggtggtctcaatatattacactctaccgaggaaacccagcaaaaaattctgtaacctccttcaacagtatacacaaaatactaatttacttatagaatcacctcaagtggagactgaaacatttcctaacgctttagaaaaagacaaacagaattattctacacgagagcagtcaggaacaccttcatgtgaaaatctaaagatgtccgtcaactctgatcagacgctcaccactgaaaatatgactgccttccgattatcaaatagggggcccctagctcctacattacaggaaatggcttctgttgaggcagctgtttctcttcctgaagaggaatctaaagctagagagattttttcagataatttagctaaaacacctctaggtgattcagaaaacaagaaggaaagaggcaaaaagttgcaaagtgaaaccctgcatacttcattgatgcttcagagaaaaaatgtatccgaagaaaaatctgaaaattgtcaacaatccattaattcaagtaacagtggtccctctagtcttccagctctttcagaagttaatattggaaattcccaaactagaagaagttcttgggagtgtacagggagtggtagagccattccatttactggaagtggcaagtgtccccagaaagatcacacatccacagctgtaggtgatggctccagtggatcacagcctagggaaggcagaggggacattggaaccaactgccaaaaaatgactaataaaacactttctcactcagagagtcaagtctttgcccttactccagcattgcataaactacagcttggtgaggagactcagtcagatgaaccaaacttagagagtctgcagtctgaaccaagagaattacctcaaagaagtcaggaggcaaatatgacagagagcaggaaggctgaagatgaaatgcagaagtcagcttgggatcaaccttcacttcctgaaggaaacaaaaataaaaccaacttggatgacctagtaaagggggaaaatagatcttcagttaaacacagattggcagccatgtctaaagccagcagaaaattcccagctaaagatgtaagccccagaagacatgtagctactatcttcccccaaagtggaagcagatctggctttgaccatttatctcttggcacagtggagtgcaacccactgttccctgagcctactccaaaatctgcagagtccattggcgaaagcaggttgagtgagaacggaaagcatgtgaagaaatccgagaaccttctccccattactgtactacccaacagagaaccttctacacacgtcagcaaccagaagtctaacagcatttcacaacgacatcagaatgagtttaaaaacgtctcagaatcaccatcaaagcatgagaattctaaagacgtcacagcagctcagaatttagtaagagaatcaggagccccatcacccatcacattcaccagcctcagggaagcagaattctctgacaatcagaggaggctgagccctccttttccactggagcctgcacagaaatctagagtaagcagtccactggccagttttctgcagcaacaaaggagtgcttcatctctggagtgggaacctgagccacacctctatcgttcaaagagtttaaaaagcattaatgttcatggcgatctactacgaaaaagccatcctccaaaagtcagggagcgccatttttctgaaagcacttctattgacaatgccctgagtcgactgacccttgggaatgaattctctgtcaacaatgggtacagtcgaagattcagatctttttctgaactcccctcctgtgatggaaatgaaagttgggcttatcgcagcgggacaaaaacaggtcccaggtctgcaatatctatatacagacctatcgactatgggatctttgggaaagaacaacagttagctttcttagaaaatgtaaagaggtcacttacacaaggaagattatggaaaccaagttttcttaagaaccctggcttcctaaaagatgatttgaggaaccctcccaacccctcagagtcattaagctcaaattctcccagtagtcaggtgccagaagatggcttatctccaagtgaaccgcttaatatctatgaggatgacccagtggactcagattgtgacacagacacaaccacagatgatgaatactacctggatgaaaatgacaaagagtcagaactgtgaggctttttcaataaaatgctttacttttttcaccaaaagcttataatggaactaaggtgtacatgtgcatgtgcatggaaggataaaagatctagtctgggcagtgtctgctctgaaatgtcccacatctccttttttttcctccacaccctatatagacacttcctgaatgctagaacaatgaattcttgttttgagagagtctctgctattttctatctctgtaaatgttcttagcctgcctttccaccactcccacttaatccctgattcactgtctgatttgggctttctgctttacttccctcctaacatttttcatctttaattgtgatttacaaccctaatatcccaggcacatacaaaacttatgaattacccagcacaactgtgaaactctgtattgcttcttccggtccacaccctatactcatgacattaaataaaaggtagggatgataacagtggggtaaatattatcatcctgtttgactcatgaacatttaggaagtttaaggtggtgatcttctctttcaaacaaagataaaggaatttattttttaacctgagaaactgattgcaaaaaggaaaaaaaaaa

SEQ ID NO: 287 - DNA, 3206 bp, Homo sapiens
  CDS (16)..(3075)
tttcgtggctccgggatgtccgcgctgtgcgaccctcccggggccccagggccacctgggcctgccccggccacccacggtcccgcgcctctcagtgctcaggagctgtcccaggaaatcaaggcttttctgactggcgtagaccccattctgggccaccaactctcagcccgggaacatgctcgctgtggtcttctcctgctccgttctttgccacctgctcgggctgctgtgcttgaccacttgagaggtgtctttgatgagagtgtccgggcccacctggctgccctggatgaaacccctgtggctggtccacctcacctccgtccacctccaccctctcatgtccctgctggtggacctggtctagaggatgtggttcaggaagtgcagcaggtgctgtctgagtttatccgggccaacccaaaggcctgggcacctgtgattagtgcatggtccattgacctcatggggcaactgagcagcacgtactcaggccagcaccagcgtgttccccacgctactggcgctcttaatgaactgctacagctgtggatgggttgtagggccacgcgtacattaatggacatctatgtgcagtgcctctcggctctcattggtagctgcccagatgcgtgtgtggatgccttgctggatacctctgttcagcattctccacactttgactgggttgtggcacatattggctcctcttttcctggcaccatcatttcccgggttctctcctgtggccttaaggacttttgtgtccatggtggggctggaggtggagctggcagtagtggtggaagctcttctcagaccccctctacagaccccttccctggatctcctgccattcctgcggagaaacgggtgcccaagattgcctcagttgtaggcatcctaggtcacctggcctcccgccacggagatagcatccgacgggagctcctgcgaatgttccatgatagcctggcagggggatctggaggccgcagtggggacccctcccttcaggccacggttccgttcctactgcagctggcagtcatgtcaccagctttgctgggcactgtctctggagagcttgtggattgcctcaagcccccagctgtgctgagccagctgcagcaacaccttcaaggattcccccgagaggagctggacaacatgttgaacctggctgtgcacctggtgagccaggcctctggggcaggtgcctaccgcttgctgcagttcctggtggacacagctatgcctgcttcggtcattaccacccagggcctggctgtgccagacaccgtgcgtgaggcttgtgaccggctaatccagctgctgctgctgcacctgcaaaaactggttcatcaccggggagggtctcctggggaaggggtgctaggcccgcccccacctccccgcttggtgccctttttagatgcgctcaaaaaccatgttggagagctgtgtggagagacgttacgattggaacggaagcgcttcctctggcagcaccagctcttgggcctgctgtctgtctatacccggcctagctgtggacctgaggccttgggccatctgctgagccgagcccgaagccctgaagagttgagtttggccacccagttatatgcagggctagtggtcagcctctctggcctcctgcccctggctttccgaagctgtctggctcgggtgcatgcagggacattacagcctcccttcacggcccggttcctgcgcaacttggcactgctagtagggtgggaacagcagggtggcgagggccctgcagccctaggggcgcactttggggaatctgcctcagcccatctgtctgacctggctcctctcctgctacatcctgaggaggaagtagctgaagctgctgcctctctcctggccatttgtccctttccttctgaagccttatccccctcccagctcctgggactggtaagggctggggtgcaccgcttctttgcctctctgaggctgcatggacccccaggtgtggcctcagcctgtcagcttctcacccgcctgtctcagacatccccagctgggctcaaggctgtcctgcagctgctggttgaaggagccttacatcgaggcaacacagaactgtttggtgggcaagtagatggggacaatgagactctctcagttgtttcagcttctttggcttctgcctccctgttggacactaaccggaggcacactgcagctgtgccaggtcctggagggatttggtcagttttccatgctggagtcatcggccgtggcttaaagccacccaagtttgtccagtcacgaaatcagcaggaagtgatctataacacccagagcctcctcagcctcctggttcactgctgcagtgccccagggggcactgaatgtggggaatgctggggggcacccatcttgagtccagaggcagccaaagcagtggcagtgaccttggtggagagtgtgtgtcccgatgcagctggtgcagagctggcctggccccccgaggaacacgcccgggccaccgtggagcgggatctccgcattggccggcgcttccgcgaacagcccctgctctttgagctgttaaagctggtagcagctgcacccccagccctgtgctactgttccgtgctgcttcgggggctgctggccgccctcttgggccattgggaagcctctcgccaccctgacacgacccactccccctggcacctggaggcatcctgcaccttagtggctgtcatggctgagggaagcctcctgcctccggccctgggtaatatgcatgaagtatttagccaactggcacctttcgaggtgcgtctgctgctgctcagtgtctggggttttctccgggagcatgggcccttgcctcagaagttcatcttccaatcagagcggggtcgcttcattcgggacttctccagggagggtggaggtgagggtggaccccatctggctgtgctgcacagtgtcctccaccgcaacatcgaccgcctaggtcttttctctggccgtttccaggcaccttcaccgtccactctccttcgacaggggacgtagccttttcttgctctggaagcccagggaggttgagcagtgagagagggaagggactaacgtgctccggaagggtggaggtttctcttctaagtccttggtctaaagagcgctgtcacttttttctctcccac

SEQ ID NO: 288 - DNA, 2011 bp, Homo sapiens
  CDS (456)..(1826)
ctgtatatggaatctgtgactgttcttccaagcggggacttgaggagtctgagcttgataaagagagccagctggtcaccccgggccattttcttccatctggtttaggtgcatatggcctcctgctggccattctgatcgacgtcatccaagatggagtcgcagccgggccttctgggaagcgtagttctggagtagggctagggaaacgttctgcgcatgtgcagtgtcttctttctggcattggcgtttttttggtcttacgccctagggtggggagaggactccggtgcctccgggtctgggctgggccgcaaagggcggggcctgggcccggcgcgggccgggagcagaggccgagaccctgcaggtgattcctggggctgccagctaaggtcccttatgatttctgctctggctttgcagttttcagcctttcccaagagcagcagaaaatgaacaagttccagggacccatgacattaaaggatgttattgtggaattcaccaaggaagaatggaagttactgacccctgctcagaggactctgtataaggatgtgatgctggaaaactatagtcaccttgtctcagtgggttaccatgtgaataagccaaatgcagtcttcaagttgaagcaaggaaaagagccatggatattagaagtagaatttccacatcggggcttccctgaagacctatggagcattcatgatctagaagcaagataccaggaaagccaagctggaaattcaaggaatggagaactcacaaaacatcagaaaactcataccacagagaaagcctgtgaatgtaaggaatgtgggaagttcttctgccagaagtctgccctcatagtacatcagcatactcactcaaagggcaaatcctatgactgtgataaatgtgggaaatctttctctaaaaatgaagacctcataagacatcagaaaattcacacgagagataaaacctatgagtgtaaagaatgtaagaaaatattttaccacctatcatctctcagtagacatctgagaacccatgcaggagagaaaccctatgaatgtaatcagtgtgaaaaatccttctaccagaaaccacatctcacagaacatcagaaaacacacacaggggagaaaccttttgaatgtactgaatgtgggaagttcttctatgtgaaggcatacctcatggtacatcagaaaacacacacaggggagaaaccctatgagtgtaaggagtgtgggaaagccttttcccagaagtcacacctcacagtacatcagagaatgcacacaggggagaaaccctataaatgtaaggaatgtgggaaattcttctctaggaattcacacctcaaaactcatcagagaagtcacacaggagagaaaccctatgaatgtaaggaatgtaggaaatgcttctaccagaagtcagccctcacagtacatcagcgaactcacacaggggagaaaccctttgaatgtaataaatgtgggaaaacattttactataaatcagacctcactaaacatcagagaaaacacacaggggagaagccctatgaatgcacagaatgtggcaaatcttttgctgtgaattcagtcctcagattacatcaaaggactcacacaggagagaagccctatgcatgcaaggaatgtgggaagtccttttctcagaagtcacattttattatacatcagagaaaacacacaggggagaagccctatgagtgtcaggagtgtggggaaacctttatccagaagtcacaactcactgcacatcagaagacacacacaaagaagaggaatgctgagaagtaagatgagttgggaaattctcttgactgaattaatccttcaaaacaatcagataattcacacaagaggtacaccttatgaatcgcatcaatagagggaaattttcagctacaatctttgctctctctgtgtatcagcaaatacatagagagattctgtacatttatttgggagaaaattttatcata

SEQ ID NO: 289 - DNA, 2309 bp, Homo sapiens
  CDS (72)..(2039)
gcgtgctgtgaatttaatatggctgcgctgggatctgttcaccttcaggctgagtcgagactgaggattatatggtttttgaggacgtggccatacatttctcccaggaggagtggggaattcttaatgacgttcagagacacctgcacagcgatgtgatgctggagaactttgcacttttgtcctcagtaggttgttggcatggagccaaggatgaggaggcaccttccaagcaatgtgtttctgtaggagtgtcacaggtcacaactttaaagccagctttgtccacccagaaggcccagccctgtgagacatgtagctcacttctgaaggacattctacacctggctgagcatgacggaacacaccccaagcgtacagccaagctttacctgcaccaaaaggagcatcttagagagaagctcaccagaagtgatgaagggaggccttcgtttgtgaatgacagtgttcacctggcaaagaggaacctcaaatgcatgcagggtggcaaggattttactggtgattcagatcttcaacaacaggctcttcacagtgggtggaagccacacagggacactcatggtgtggaggcctttcaaagtggacagaataattacagctgcacccaatgtgggaaagacttttgccaccaacatacactgtttgagcaccagaaaatccacacagaggaaaggccttatgagtgcagtgaatgtggcaaattgtttaggtacaactccgaccttattaaacatcagcgaaatcatactggagaaaggccttataagtgtagtgaatgtggaaaagccttcagcctcaaatacaatgttgttcaacaccagaaaattcacactggagaaaggccttatgagtgcagtgaatgtgggaaagcttttcttagaaagtctcacctacttcagcaccagaggattcacaccaggccaaggccttatgtgtgtagtgaatgtgggaaggccttccttacacaggctcaccttgttggtcaccagaaaattcatactggagaacggccttatggatgcaatgaatgtgggaaatactttatgtacagttcagcactcattagacatcagaaagttcacactggagaaaggcctttttattgctgtgaatgtgggaaattctttatggacagctgcacactcattattcaccagagagttcatactggagaaaaaccttatgaatgcaacgaatgtgggaaattctttagataccgttccacactcattagacatcagaaagttcacactggagaaaagccttatgagtgtagtgaatgtgggaagttctttatggacacttccacactcattattcatcagagagttcatactggagaaaagccttatgaatgcaacaaatgtgggaaattctttaggtattgcttcacactgaatagacatcagagagttcactctggagagaggccttatgaatgcagtgaatgtggcaaattctttgtggacagctgtacactgaagagtcatcagagagttcacactggagaaagaccttttgaatgcagcatttgtgggaaatcctttagatgtcgctccacacttgatacacatcagagaattcacactggtgaaaggccttatgagtgtagtgaatgtgggaaattctttaggcacaactcaaatcatattagacatcggagaaatcactttggagaaaggtcttttgagtgcactgagtgtgggagagtttttagccaaaattcccacctcattcggcaccaaaaagttcacactagggaaagaacttacaaatgcagcaaatgtgggaaattttttatggacagctccacactcattagtcatgagagagttcatactggagaaaagccttatgagtgcagtgaatgtgggaaagtctttagatacaactccagcctcattaaacatcggagaattcacactggagagagaccttatcagtgcagtgaatgtggaagagtctttaaccaaaattctcatctcattcagcaccagaaagttcacaccagataaagaatgtatatataaagcagatggggaaagacttcacacagaaatctactctgatttagcactgggacctacgttttaaaaaaagtattcttgtagaatacagataacataaaatctaacatcttaaccatgttaaagtgtatagttcagtaccgttaagtcattcacattgtgcaatgaatatctagaagtcttttcaacttatgaaactaagtctataccttttaaaaccttattcctcactccatccagcctcttgacaagcaccgc

SEQ ID NO: 290 - DNA, 459 bp, Homo sapiens
  CDS (8)..(319)
aaggatcatgggttttgttttctttattttcttcttttgcaaggattgccatactaaggaattcctcattatattttgtgttgttcccattgcagccagtcagaaatcttccaacttggaagggagaacgaagtcagtcatcaggcagactgggtcatctgctgaaatcacttgtgatcttgctgaaggaagtaccggctacatccactggtacctacaccaggaggggaaggccccacagcgtcttctgtactatgactcctacacctccagcgttgtgttggaatcaggaatcagcccagggaagtatgatacttagagcagactccgggacacaccaacacacatgatcctcagtccttttaataaagcacgttcaacccttctcagagtgaccttgagtggttgcctccatgagtccaacatctgcagtccctcagctggaggcttgagacgaaa

SEQ ID NO: 291 - DNA, 1256 bp, Homo sapiens
  CDS (610)..(1173)
atctccgaaggggacgaacaaaggtgatgttcccccatcccagcaccctccctcgccacctcggccgcgtccagaagcgtctcattcagatagaggtacccagccgggccccaggtctcacctgggtcagcattgtcccgctgagagctttcaaacaacaggtgtacgcgaatcagtatcaaaaagcctccagggaactgaaaaaaacagtctgacttccgggattcgcgggcatccactttcattctcacgtttcctcttcaatttctcgcgagatactgatttgctcgcgctatagaattcttgtcgaagaggcttagctcccgcgggagatttcgtgcgcagttacttccggtagctggtaaaggctgatacttcccaggacgcggaggtaacgggccagggccaaagcgactttcgctacttggattggtcggcgtagctttgggcggccggaccttaaaaagtcacacatctgcgcgcctgtgcggcccctgcttctgcggatgctgaggcacgtaaaaaaatttgaagaagggaatttcgcggcattcttggcctggcttcctggcgtagccagcaagttcggaggtgttaaccgctgctgtcatgtttcttttgctaaactgcatcgtcgctgtgtcccaaaacatgggcatcggcaagaacggggacctgcccaggccgccgctcaggaatgaattcaggtatttccagagaatgaccacaacttcttcagtagagggtaaacagaatctggtgattatgggtaggaagacctggttctccattcctgagaagaatcgacctttaaaggatagaattaatttagttctcagcagagaactcaaggaacctccacaaggagctcattttcttgccagaagtttggatgatgccttaaaacttactgaacgaccagaattagcaaataaagtagacatgatttggatagttggtggcagttctgtttataaggaagccatgaatcacctaggccatcttaaactatttgtgacaaggatcatgcaggactttgaaagtgacacgtttttttcagaaattgacttggagaaatataaacttctgcctgaatacccaggtgttctctctgatgtccaggaggggaaacacatcaagtacaaatttgaagtatgtgagaaggatgattaatatgaaggtgttttctggtttaagttgttccccctccctctgagaaaagatatgcatttttacattagaaaagggactgtatt

SEQ ID NO: 292 - DNA, 2658 bp, Homo sapiens
  CDS (46)..(2454)
gggtcgacgatttcgtagcggccgggcccacggccccgagcagccatgctgggcgcgcgggcctggttgggccgcgtccttctgctgccccgcgccggtgcaggcctcgccgcgagccgcaggtgtcctggagtctggcccaggacctggccccacaggagtcccagcaggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactggtacccctggggacaggaagccttcgacaaggccaggaaggaaaacaagccgattttcctctcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggccaccagcagcggcgggggctggcccatgaatgtgtggctgactcccaacctccagccctttgtcgggggcacctatttccctcctgaggatggcttgacccgagtcggcttccgcacagtgttgctgagaatacgagaacagtggaaacagaacaagaacaccctgctagaaaatagccagcgtgtcaccactgccctgctggcccgatcagagatcagcgtgggtgaccgccagctgccgccctctgccgccaccgtgaacaatcgctgcttccagcagctggatgagggctatgatgaggaatacggtggcttcgctgaggcccccaagtttcccacgccggtgatcctgagcttcctgttctcctactggctcagccatcgactgactcaggatggctctcgggcccagcagatggccttgcataccctgaaaatgatggctaacgggggcatccgggaccatgtggggcagggctttcaccgctactccacagaccgccagtggcacgtccctcactttgagaagatgctctatgaccaggcacagctcgctgtggcctattcgcaggccttccagctctctggtgatgaattctactctgacgtggccaaaggcatcctgcagtacgtggctcggagcctgagccaccggtccggaggcttctatagcgcagaggatgcagactcgcccccagagcggggccagcggcccaaagagggcgcctactatgtgtggacggtcaaagaggttcagcagctcctcccggagcctgtgttgggtgccaccgagccgctgacctcaggccagctcctcatgaagcactacggcctcacagaggctggtaacatcagccccagtcaggaccccaagggggagctgcagggccagaatgtgctgaccgtccggtactcgctggagctgactgctgcccgctttggcttggatgtggaggccgtgcggaccttgctcaatacagggctggagaagctcttccaggcccggaagcatcggcccaagccgcacctggacagcaagatgctggctgcctggaatggcttgatggtgtcaggctatgctgtgactggggctgtcctgggccaagacaggctgatcaactatgccaccaatggtgccaagttcctgaagcggcacatgtttgatgtggccagtggccgcctgatgcggacctgctacaccggccctggggggactgtggagcacagcaacccaccctgctggggcttcctggaggactacgccttcgtggtgcggggcctgctggacctgtatgaggcctcacaggagagtgcgtggctcgagtgggctctgcggctgcaggacacacaggacaggctcttttgggactcccagggtggcggctacttctgcagtgaggctgagctgggggctggcctgcccctgcgtctgaaggacgaccaggatggagcagagcccagcgccaattccgtgtcagcccacaacctgctccggctgcatggcttcacgggccacaaggactggatggacaagtgtgtgtgcctattgaccgccttttccgagcgcatgcgtcgtgtcccggtggcgttgcccgagatggtccgcgccctctcagcccagcagcagaccctcaagcagatcgtgatctgtggagaccgtcaggccaaggacaccaaggccctggtgcagtgcgtccactctgtctacattcctaacaaggtgctgattctggctgatggggacccctcgagcttcctgtcccgccagctgcctttcctgagtaccctccgacggttggaagaccaggccactgcatatgtgtgtgagaatcaagcctgctcagtgcccatcactgatccctgcgaattacgaaaactactacatccatgactgccccaacccccttggggtggggcagaaggtgaagcatcccaactgactagagactcaggccctgcagggccctatagaacctgtggccatccctgagcaccctgccaccaggtgacctcggccatactcactgccccccttgggcacccactcaccctagaataaacttaacagtgtcccgtggtaaaaaaaaaaaaaaaa

SEQ ID NO: 293 - DNA, 974 bp, Homo sapiens
  CDS (171)..(782)
aaggatccttaattaaattaatcccccccccccagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagcccacagtcaccagcgtgtgttccgagacttctcaggagctagcagagggacagagaagaggatcccagggtgacagtaaacagcaaaatgggaaaatcccacctaaacgcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcatagtttgacagtgctctggaagacctacctaagagtggacctcaccctcctgcaacttctcaggtgttaactattggtagccaagtgggcacactttttaaaggagccacttactatttttattttaaccgcttcccagggaaatggggaaaaattctttcgaagttttcgaaacttttctaccttctttttttg

SEQ ID NO: 294 - DNA, 1803 bp, Homo sapiens
  CDS (7)..(1776)
acggcgatgacgccaccgacaggacgacgactgtgtctcgcgccctgcggcggcatttatgtgccggactctaggggtacattttctgagacgggaaaacctgcattgataaaagtgggacagagcggggtcagaccgctcctaactgtccccctgaccccgcgatgggttagacttcgtgctcgcctgggaggagaagctgcgacccccgcggcggcgggagagaggcgactccggcagcggcgctggcgcgagaattttcagcggaacctggaggagggcctctttgaactgcctgggtaccaggtacccggttcagatctcaactcttgccaattgctgtacccatactgggcttgctggggatactggcacaagtaccagcccctggaccagcctttggacaaactgagctgcctctttgaccacccaggaaccgtgttcttcagcatcttcatgtccttctggggccatggccttcctggagcactggaagcagggagtgccaccttggcccaccactgggactgcagtgacttccaggaccaggaggcaatgcccagttcagccccccaccactgggactgcagcgacttccaggaccaggaggtgatgcccagttcagccctccaccactgggactgcagcgacttccaggaccaggaggagtgcccacatctacagtttgctgccctggccctgcagatgacccagaacccagtgacaggcttgaaggagccctacttccaaccgcacagctgcctttcccacctactcaccagctctgcagccatcctcactgtgctctgtgtggtgatgattttcctggtatctgtcataatttaccatggcatcatcagcattgcaatgttccacactggcaactctgtgctcatgacccaagcgaatgtcctttggggcaatggaggccccaaagccctgagtaaggtgctctgtgtctgccaacaacagtgcggtcctggtggctgccacattcaggtcacccagcagctcatcatcatcatggtgggcaaacagctgctcaaccacatggaagaatttgttgggctgggaggtggccccgggcctgacactccctgcctgccagagctgcagtttgggttcatcaccatctttgtgggagccttcctgctggcacccctgttcactctgctcaacaaccgggtagagattggactggacgcccacaagttcctgtgcaagtaccagcgaccaatggctgggcgcggctggacatctggatctgactgctcctgctggaggccatgtgagctgattctgccccggacaaatgcgcggagccggctagggtactggctgaacgggcagggccagattctagggagaaggaggggaggaaatgcggggttcggagtcgagatccgagagcctctccagaccccgcaacccagatacaaggcctctcgcgacgtgggggtgaacctcgccctcttctactggaagctgctggctgtgcatgtgcatctgggtttcattatcgccttcgagaatgtagtgttcttcttcctgtgccccaacgaccggctcgtgcccgatgtgccagccctggctaccaagataactgcgcgagcgctacctggccaagcaggcggtggcagacaaccgggagacgctgtttcagtcagcaaggcaggcggaccccggccccacccgcagcataatgaccataatgaccacgccccttggcctgccctcaagcttcagctcagccctctcaagttcagcactctctagccccgcgtactctgcgttgttaccact

SEQ ID NO: 295 - DNA, 3943 bp, Homo sapiens
  CDS (575)..(3943)
atggttcatggagctgaaatgaatgcattcaatgaacattgtcgaggactaaccctgccagagccccttccagggcctcccatccgcctacatctctctccggtggggatcccaggttcagccagaccctcaaggctggagcgtgtggcccgggagatcgtggagacagaacgggcctatgtcagggacctccgcagcatcgtggaggactacctgggccctctgctggacggcggggtcctggggctgagcgtggagcaggtgggcacgctgtttgccaacattgaggacatctacgagttcagcagcgagctcctggaggacttggagaacagcagcagcgccgggggtattgccgagtgcttcgtgcagaggctccctggccctgctccgggagctgtcgttgtctccgccagcagccctgtggctgcaggagcgccaggcccagcttcgccactcgctgcccctgcagagcttcctgctgaaacctgtccagcgcattctcaagtaccatctgctgctgcaggaactagggaagcactgggcggagggcccaggcactgggggtcgcgagatggtggaggaagctattgtgtccatgacagcggttgcctggtacatcaacgacatgaagcgcaagcaggagcatgcagcgcgcctccaggaagtgcagcggcggctgggtggctggaccggaccagagctcagtgcttttggggaactggtgttggagggcgcgttccgaggaggcggagggggtggcccccggctacgagggggtgagcggctgctcttcctgttctctcggatgctgctggtggccaagcgcagggggctggagtacacctacaaaggccacatcttctgctgcaacctgagcgtgagcgagagtccccgagaccctctagggttcaaggtgtctgatctgaccattcccaagcacagacacctgctccaggccaagaaccaagaagagaagaggctgtggattcactgtctccagcgcctcttctttgagaaccaccctgcctccatccctgccaaggcaaagcaagttctccttgaaaacagcctgcattgtgcccccaaaagtaagcctgtcctagagcccctgacacccccacttgggtctcctcgacctcgagatgctagaagttttacccctgggcgaaggaacacagctccatctcctgggccctctgtgattcgccgaggccgcaggcagtctgagccggtgaaggacccttatgtcatgttcccacagaacgctaagcctggattcaagcacgctggcagcgaaggggaactctaccctccagaatctcagccaccagtttcaggctctgcaccccctgaggacctggaggatgctggacccccaacactggacccctctgggacctcaatcactgaagaaatcctggaactgctgaatcagcgaggccttcgagatccagggccgtccacccatgacattcccaagttccccggagactcccaggtgcctggcgacagcgaaaccctcacattccaagccctgcccagccgggactcttcagaagaggaggaggaggaagaggaagggctggagatggatgaacgggggccttccccactccacgtcctggaagggctcgaaagttccattgcagctgaaatgcccagcattccctgccttaccaaaattcctgacgtgcccaaccttcctgaaattcccagccgctgtgaaattcccgaaggttctcgccttcctagtctctctgacatttccgatgtttttgagatgccctgccttccagccatacctagtgtccccaacacccccagtctgtctagcactcccaccctctcctgtgactcctggctccaagggcctctgcaggaaccagctgaggctccagccaccaggagagaactgttttctgggagcaatcctgggaaactgggagagccgccttcaggaggcaaggcagggccagaggaggatgaagaaggggtatcattcacagacttccagccccaggatgtcacccaacatcagggattcccagatgagctggcattccgctcttgctcagaaatccggagcgcctggcaggcattggaacagggacagctggcccggccaggcttcccagagccactgctgatcctggaggattcggatctgggtggagacagcgggagcgggaaggcaggagccccgagttcagaaaggacggcgtcccgagtgcgagagctggcccggctttacagcgagcggatccagcagatgcagcgggcggagactcgggcatcagccaatgccccgcgccgccggcctcgggttctggcccaaccccagccatccccctgtctgccccaggagcaggcagagccagggctcctgcctgcctttggacacgtgctggtatgtgagctggccttcccactgacatgtgcccaggagtctgtccccctgggtcctgctgtctgggttcaagctgccatacctttgtcaaagcagggaggcagcccggatggccagggtctacatgtttccaatttgcctaagcaagaccttccgggcatccacgtttcagctgctacccttttgcctgagcaaggaggttcccggcatgtccaggctccagccgccacacctttgcccaagcaagaaggccccctgcacctccaggtgccggctcttacaactttctctgatcaaggccacccagaaatccaagttccagccaccactcctttgcctgagcataaaagtcacatggttataccagctccatccaccgccttttgtcctgagcagggacactgtgcggacatccacgttcccaccactccagctttgcccaaggagatttgttctgatttcacagtttcagtcaccacccctgtgcccaagcaagaaggtcacctagacagcgagagcccaaccaatatcccactgacaaagcaaggaggttccagggatgttcagggcccagaccctgtctgcagtcaacccatccagcctttgtcttggcatggaagcagcctggatccccagggcccaggcgacaccctaccacccttgccatgtcacctcccagaccttcagattccaggtacctcacctttgcctgcacatggaagccacctggaccatcggatcccagccaacgccccactgtctttgtcccaggagctcccagacactcaggttccagctaccacacctttgcccctgccacaagtcctcacagacatctgggtccaagccctcccaacttcacccaagcagggaagcctcccagacatccagggtccagcggctgcacctccacttccggagccaagccttacagatacacaggtccaaaaactcacaccttcgttggagcagaagagcctcatagatgcccatgttccagctgccacacctttacctgagagaggaggctctctagacattcagggcctctcacccaccccagttcagaccaccatggttttgtccaaaccaggaggctccttagcctctcacgttgccaggttggagtcttcagacttgacgccacctcatagtcccccaccttccagccgtcagctcctgggccccaatgcagctgccctctccagatacctggcagcctcatatatcagccaaagcctggctcggcggcaggggcctgggggaggggcccccgcagcctcccggggctcctggtcctctgctcccacgtcacgggcatcttcgccgcccccccagccccagccaccacctcccgcagccaggcggctcagctatgccacgacggttaacatccacgtgggcgggggtgggcggctgcggccagccaaggcccaggtccggttgaaccaccctgctctcttggcctccacacaggaatctatgggccttcacagggcccagggggctcctgatgcccccttccacatgtga

SEQ ID NO: 296 - DNA, 1114 bp, Homo sapiens
  CDS (117)..(1052)
cccacgcgtccgggattttcttccaaaaatgcagacccattttaattaagtttgtaattaaccactggggagggcaggccccctggattcggtctgctttcggagacactaacaagatgggagtcatggccatgctgatgctccccctgctgctgctgggaatcagcggcctcctcttcatttaccaagaggtgtccaggctgtggtcaaagtcagctgtgcagaacaaagtggtggtgatcaccgatgccatctcaggactgggcaaggagtgtgctcgggtgttccacacaggtggggcaaggctggtgctgtgtggaaagaactgggagaggctagagaacctatatgatgccttgatcagcgtggctgaccccagcaagacattcaccccaaagctggtcctgttggacctctcagacatcagctgtgtcccagatgtggcaaaagaagtcctggattgctatggctgtgtggacatcctcatcaacaatgccagtgtgaaggtgaaggggcctgcccataagatttctctggagctcgacaaaaagatcatggatgccaattactttggccccatcacattgacgaaagccctgcttcccaacatgatctcccggagaacaggccaaatcgtgttagtgaataatatccaagggaagtttggaatcccgttccgtacgacttacgctgcctccaagcacgcagccctgggcttctttgactgcctccgagccgaagtggaggaatacgatgttgtcatcagcaccgtgagcccgactttcatccggtcgtaccacgtgtatccagagcaaggaaactgggaagcttccatttggaaattctttttcaggaagctgacctacggcgtgcacccagtagaggtggcggaggaggtgatgcgcaccgtgcggaggaagaagcaagaggtgtttatggccaaccccatccccaaggccgccgtgtacgtccgcaccttcttcccggagttctttttcgccgtggtggcctgtggggtgaaggagaagctcaatgtcccggaggaggggtaactgcaggaggccaaatgggccaccccttggaaataaaggtttttctggcaaaaaaaaaaaaa

SEQ ID NO: 297 - DNA, 1492 bp, Homo sapiens
  CDS (79)..(1434)
ccacgccgccgggcgaataactggattgaaatttataatttcgtacagcaacttgcggagagatttgtgagccctgaaatgagattatctttcattgtgttttcttctcaagcaactattattttgccattaactggagacagaggcaaaatcagtaaaggcttggaggatttaaaacgtgttagtccagtaggagagacatatatccatgaaggactaaagctagcgaatgaacaaattcagaaagcaggaggcttgaaaacctccagtatcataattgctctgacagatggcaagttggacggtctggtgccatcatatgcagagaaagaggcaaagatatccaggtcacttggggctagtgtttattgtgttggggtccttgattttgaacaagcacagcttgaaagaattgctgattccaaggagcaagttttccctgtcaaaggtggatttcaggctcttaaaggaataattaattctatactagctcagtcatgtactgaaatcctagaattgcagccctcaagtgtctgtgtgggggaggaatttcagattgtcttaagtggaagaggattcatgctgggcagtcggaatggcagtgttctctgcacttacactgtaaatgaaacatatacaacgagtgtaaaaccagtaagtgtacagcttaattctatgctttgtcctgcacctatcctgaataaagctggagaaactcttgatgtttcagtgagctttaatggaggaaaatctgtcatttcaggatcattaattgtcacagccacagaatgttctaacgggatcgcagccatcattgttattttggtgttactgctactcctggggatcggtttgatgtggtggttttggcccctttgctgcaaagtggttattaaggatcctccaccaccacccccccctgcaccaaaagaggaggaagaagaacctttgcctactaaaaagtggccaactgtggatgcttcctattatgggggtcgaggggttggaggaattaaaagaatggaggttcgttggggtgataaaggatctactgaggaaggtgcaaggctagagaaagccaaaaatgctgtggtgaagattcctgaagaaacagaggaacccatcaagcctagaccacctcgacccagacccacacaccagtctcctcagacaaaatggtacaccccaattaaaggtcgtcttgatgctctctgggctttgttgacgcggcagtatgaccgggtttctttgatgcgacctcaggaaggagatgagggccggtgcataaacttatcccgagttccatctcagttgatgttcatccaaatgaacgacatcaagtgcatttcagaagcttttggagagcagcttaattgctctcactcgggaaatgttttctctgccttatgctatgcttgcaccaaacatttctaaacacttgtgtctgcatctccatgggaggtgatgaaactcagtggtaactcatgattaa

SEQ ID NO: 298 - DNA, 3656 bp, Homo sapiens
  CDS (190)..(2628)
ctggtagacaccaaacttaagcaagaattatcaagtgaggaagaaggtgatgctaaaaagggtgtgtcaagtgtcactattatgccggaagccaatggccatttgaaatatgacaaggttgatgatttatgtggctatttggaggaagaagaggaaagtaccacataaatcatcaaacttgtcactattatgccggaagccaatggccatttgaaatatgacaaggttgatgatttatgtggctatttggaggaagaagaggaaagtaccaccgttcaaaaatttatagaccatctgctccataaaaatgtggtagattctgcaatgatggaagatcttggaaggaaggaaaaccaagacaagaagcagcagaaggatcctcgtcttaccatggagatgagacataagcaggtaaaagaaaatcgcttaagacgtgagaaagaactggagtaccagagaatagaaaagaccctgaaaaaatcggccttcttggaggctcagtgtctggtgcaagaagagaagaaaaggaaggctctggaggccaagaaagaggaagaggagattcaaagggagatggtgaagctgcggagggagataattgagaggagacgcactgtgaaagcagcatggaaaatagagaagaaaaggcaagaagagaattctcaaaatagttcagaaaaagtcatgtttcaaagtactcacattcttccagatgaggaaaaaatggtgaaggaaagaaaaaggaaattgaaagaagtattaatccaaactttcaaagaaaatcaacagtgtcaaaaacggtatttcgctgcctggcacaagctgattcttgatcataggattaagctggggaaagctgggaccctgtctgactggaagattcagctgaaggtcctgcgggcctggagagactacacaagattccagaagttggagcgggagactcaagccttggaaaatgatcttagggaagaaaacagaaaacaacaactggccactgagtataaccggaaacaagttctccgacactgctttacagaatggcagcattggcatggcgccgagctcctgaagagagagctggctctcacaaaagaggaaactaggaagaagatggatgcactgctgcaggcagcatcactggggaaactcagtgccaatgggttatcaggcatcagtctacctgaggaggcaacagccatggtgggtccaccagtaaaaaatggacaggagactgctgtgccccctttgtgggaaaagcctcccttgggaagcagtggttgtatgctcagtcctcccctgggaagaacaacaacaggcaacttgcagggttcccttcagaatgtctctctgagtgcacctggcaataagcagcacaagaccctgggtgctgaaccctctcaacagcctggcagcaacgagacactcagaactaccagccagaaagcagaaccgctttgcttgggtcatttccacaaccgccatgtcttccagcaacagctgattgagaagcaaaagaagaaacttcaggaacagcagaaaacaattctcgagctgaagaaaaacctgcagctggcagaggctcagtgggcagcagagcatgccttagcagtcacagaagcacagagccacctgctgtcaaagcccagagaagaggaaccaagaacctgccagatgcttgtgaattcacctgttgcttcccctgggactgaaggcagaagtgactcccgaaattctctttctggactcagaaggaaaccaaagcaattgatgacaccgcatcccatactaaaagctatggaagagagagcaattcaacgagctgaatgtaggcggatcttggcagagaagaagaaaaaacaagaagaagaaaaattggcccagttaaaggcccaagaggaggaacgtcagaaaagggaggcagaagaaaaggaggcacagcttgaaagaaaacgagaagagaagagactgaagaaaatgaaagaacttgagaagcagaagagaattaagaggaaccagcagctggaagcaatagccaaagaacattatgaaagggtcttgctaaggaaaaaaggtctagagccttggaagagattgagaatgcaaagcaaacaaaacatccaggtggcagaagaacattactctttgttcctgcagaggaaatacatgctgacgtggttccagcgtagtcaggaaagtctggctagaaagatggcccaggctgatcaattttattcccaaatactgcttaagagagtcatccagagctggctacagtacgtgattgatctgcaggaagaagtaagaaaattttgtgtacattttcttcaaaagaagattttcagggcctggtttaacatggtcagggaggtgaagatcgattctcagggcaagcatgagattgcagcggagcacagtgacaggaggatcctctggatcacccttcggacatggaagaagtttgtaaaatttatgaaagaggaaagagtaaaagaagaaaggcgacagcaacttcgtaggaaggtagttgaaattcttccagacttccaggtacctggaaggtaccacgagctatatcagcaatcagatacttggtccttgagtaagacaagtctggtgaacgaatgagccagattagtgtaatatttaggacaggaagctcgactagtctgtatgtgtgttatctccacccacccacacacatacatacatacacctggtttattctctacgagctacttcttagatcaaaggaattattttgagaatttttattcccttctttgacttttcctggattgctagtcattcactatagcatttatcacagtgggatcatccaaaggaacattctagagatcgtctgttcaaatatatcctatatatttttagcatagtaaactttaaaaaggacaagtgtttgcctgactgagcctgtgaagaaaatgtgtccgtatagcacgacaggagttgctgatgtgaccttaatgaaacagaaataaacaggggtgagtgctcggaaaggaagggcgggccaaggcactcagccttctagtgcagtagcatcagtgacacgcaccccaccagacctcgtccactttcaccacccctgaaggcagaccatgtatgaaaaggttctctacacagctgctgcagaggacagcagcttatcctgatttcagagaaactgaggcaccagagatgcttctcttccgtgcaccttgataagcatgaaggacattccaaaaggtaataactctatcatgacagtccagcaattcattaaattatctgttcatgctcccacctgcaactgctgaataatacactcagtttgtcttctagtactcagctcagtttgatctagatattgagatacctatcttgaattcaaagaatgttttcatctttaagatgctataaagactgataaaatgctctcttctatgaattgtgttagagaattacctgctagaaaaataatttttcattataaaatacacatttattatataacaaattcaagtagtccataaatgcatatggtaaaatgagaaagtcctgtgcagtcctgagatgattactcttatttggtgtgctgaaaatttgagttgacaaaataaaattctgtggttttttaagtgaaaaaaaaaaaa

SEQ ID NO: 299 - DNA, 5706 bp, Homo sapiens
  CDS (1)..(3129)
atgtactgtggtgtcctggtgggatcctgggacaggaagaggaaatactggtggaagctgaacaaagcgtggcatttggagaacactaaggtgctgatgctggcatcctcctcgtggatgccagtcattgaatttacggtctaccctaaatccagatggcttcatcctgagatgcttagccacgtctccaatgaccctatttccaaaattttagacagggtctttgagcgctcacctgtcttggctctctggaatggattcacgttcatggcagaggctgtgaaccctgagtttacggtcatccttgtcagctcctcactcagtgaccgggaccagagcctattcctcagcgcagacgaaggcgccacctttcagaagcagcccattcccttcttcgtggaaactctgattttccaccctaaggaggaggacaaggtcctcgcctacacaaaggagagcaagctctacgtgtcatctgacttggggaaaaagtggacacttctgcaagagcgagtgaccaaagaccacgtgttctggtctgtgtctggggtggacgctgaccctgacttggtccacgtggaagcccaagacctcggtggagattttcggtacgtcacctgcgcaatccacaattgctccgagaagatgctgacagccccattcgcaggccccattgaccacgggtctctgaccgtgcaggacgattacatcttctttaaggcaacatcagcaaaccagacaaaatactacgtctcttatcgtcgaaatgaatttgtcctgatgaagctgccgaagtatgcattgccaaaggatctgcagatcatcagcacggacgagagtcaggtgttcgtggcggtgcaggagtggtaccagatggacacctacaacctgtaccagtcggacccacggggcgtgcgctacgcgctggtgctgcaggacgtgcgcagctcacggcaggcggaggagagcgtgctcatcgacatcctggaggtcagaggggtgaaaggagtcttcctggcaaaccaaaaaattgatgggaaagtgatgacgcttataacctacaacaagggccgcgactgggattacctgaggccacccagcatggacatgaatggaaaaccaaccaactgcaagcctccagactgccacctgcacctgcacctgcgctgggcagacaacccctacgtatcaggcaccgtgcacaccaaggacaccgccccaggcctcatcatgggtgcaggtaacctgggctcacagctggtggaatataaagaagaaatgtacatcacgtcagactgtggtcacacctggcggcaggtgtttgaggaagagcatcacatcctgtacctggaccacggcggcgtgatcgtggccatcaaagacacctccatccctttgaagatcctcaagttcagtgtggacgagggcctcacctggagcacgcacaacttcaccagcacctcggtgtttgtggacgggctgctgagtgagccaggggacgagacgctggtcatgacggtctttggccacatcagcttccgctccgactgggagctggtcaaggtggacttccggccctcattctccaggcagtgcggcgaggaggactacagctcctgggagctctccaacctgcagggcgaccgctgtatcatgggccagcagagaagtttccggaaaagaaagtccacgtcctggtgcatcaaggggaggagcttcacgtcggcgctcacgtcccgcgtgtgcgagtgccgggactcggacttcctgtgcgactacggatttgagcgctccccctcctcagagtccagcaccaacaagtgctctgccaacttctggtttaacccattgtccccgcctgacgactgtgccctaggccagacctacaccagcagccttgggtaccggaaagtggtgtccaacgtgtgtgagggtggggtggacatgcagcagagtcaggtgcagctgcagtgccccctcacgccgccccggggcctgcaggtcagcattcaaggcgaggcggtggccgtgcggcctggagaggacgtcctgtttgtggtgcggcaggagcagggtgatgtcctgactaccaagtaccaggtagaccttggggacggcttcaaggccatgtacgtgaaccttacactgaccggggagcccatccggcaccgctacgagagccccggcatctaccgcgtgtccgtcagggcagagaacacggcaggccacgatgaggcggtgctctttgtccaggtcaactcccccctgcaggccctctacctggaggtggttcctgtcattggcctcaaccaggaggtgaacctcacagctgtgctgcttcccttgaaccctaacctcaccgtcttctactggtggatcggccacagcctgcagcccctcctttccctggataattctgtgacaacgcggttttcggacacgggcgacgtgcgtgtgacggtgcaggccgcctgtgggaactcggtgctgcaggactccagggtcctccgtgtgctggatcaatttcaagtcatgcctctgcagttttccaaggagctggatgcctacaaccccaacacccctgagtggagggaagacgtgggcctggtggtcacccggctgctctccaaggagaccagcgtccctcaggagcttctggtgactgtggtgaagccggggctgcccactttggccgatctgtacgtgctcctgccccctcccaggcccacaaggaagaggagcctctcgagtgataagaggctcgccgccatccagcaggtgctgaacgcacagaagatcagcttcctcctgcgaggcggagtccgggtcctggtggccctgcgggacacaggcacaggtgctgagcagctgggcggcggtggcggctactgggcggtagtggtgctgtttgtcatcgggctcttcgcagcgggagccttcatcctctacaagttcaaaaggaaacggccaggcaggaccgtgtacgcccaaatgcacaacgagaaggagcaggagatgaccagccctgtgagtcacagtgaggacgtccagggcgctgtccagggcaaccactcaggcgtggtcctgagcatcaactcccgagagatgcacagctacctggtgagctgatgccaccccagcatctgtcttttcacccacggagggcacagaaccaccagcaaagccggcggctggactggcgcccctcagagacctgcggaaagccccctccctgagtcgtcgccacaccaggcgacaggcaccaccccctctgataaatccaagcccgcccaggcccacggggggcccacgggaccccccgggactccccggacatggccctgcccctatgggacaccaggcctgactcaggcaggttctgccccccagaccccacacacggccgccccacgtgctgtcgctcagcccgaggcctgacttctctgggctgaggctggtcgtcctggagccctcccagtacctcgggctgcaagagctgcagacccgttcagacactgcgttgcgggctccttccccgcagaggccggggcctccctgactttgcttcttcactcccacctgtgcggccacccagtccctctgtgggagcccgggtgccaggccctcccaacaccacaccaccctccaggcccccctgccctccggctggaaactgcagctctgtaaatgcctctctaggtagctgctggcggtggtgggggtgtctcactctctgtctttatagccggcggtagccaccggggtggctctgtcagagttccgtactcgggagcccctttccctgagtgcccagggtgtctcctctgcccagaggggcagcagctctccctggttctccccagggcagacggggtagggcgggctcaggacccagtgcccatggttcctcactcctaccagcaagcagcaccatcccgcaggcttctcccacctgatggctgttctcccaccgggtctgggctctggaaggagccagatgcccccagaaaggtgggtggtggagacggcaccagatgtaccagttttctgcagttccttataggcgaagggaaccgggtggaaaccaagctgggagaggctgaggatggcagggctggaagggccatcagcgtgaccctcattttcaagaaggggaaactgaggcccagggaggagagtaactgaaggtcacagcacggtcacagcagaggtggccgaacccagccctctgcgcgccagtgctgtgcggtctccacacccttacggtttcctagaatcagggatgttagtgtaagtctataggaatataggggggtgggggggtcaccttttgccttgaaatgggaagtcagtagccccttcctcctcctccctcctccccctcctctctggcagggatctcagatgaccgtggcctcccgctcagagggggagaacgccagagccctggctggtgatgtgctggctgggggtgaatcccaatgagggtccctctcagagcgggagaacgccagagccctggatggtgatgcgctggctgggggtgaatcccaatgagggtccctctcagaaagggagaacgccagagccctgggctggtgacatgctggctgggggtgaatccgaatgacagtgcagacgttctcccatccaccatgtctgagcttgggggaattgcctcatttaccctggaaaagaaacatggtccattagagggggaaagcccaggggtgaatcttcacgccccaaacagtgcccggtggggaggaggcacccgctccttgttgagtaaaaccacccatggagactggaacctcatctccctgggtcggggggtgttcaaggccacaggacaaggggagcaccctgggccacacaggcgtggaggtgtccccaccccttccacctgtcccccagacccaaagctctctccccaccctacctgcccacctggggctcctgtgccccctccccactccagaggccaccctacaagttgtcctcaaggtcatcctggagatgggatccaggacgtggggccatgactctctgggaccttgccacagcccccattcccctgcttgcagtctgcaaggacacctttgcagggattcttgtcctgctggccaccccacccacacctgtccctggccagcaggccgcctgcaagcgtcaggcacacagggacagacatggcgagcacagtgcaggcccggggcccacgggcaacatggaaccctgggaactgccctcccccttagctcacagtgcctgcggtagccactctaggtcgttggccttccttgaccactccatttaattctctctgctgtttgggttgggtttttccccttagttatctgtgggtttcctgtattttatgttaatatttctattaagaacatgttgggcatgtggacccaagcacctgggaaggaggtggcatctgagacagcctgatacgttcccgtctgtgcacccatggagatccaggcgtgggcccgtggctgtccctggttgtaaattcgagggtctgcatatctgatgttcaggtagacctgggcgcctgggaacgaggccatcagctgccatgcacataacaaagagacaatgcattccttcttatttttcctttttaaaaatcgatgaatcatttgtgatgcttttaacaaagattaaatgaatttgatcagcaaaaaaaaaaaa

SEQ ID NO: 300 - DNA, 2196 bp, Homo sapiens
  CDS (431)..(1777)
tttcgacgatttcgtagcgcccccggaggcgctaagcttgcgctctgaggcggtttccgttcccggacgtttggactctgtcctggagaaggggaaggaaaaagtaagacgtagaagtacactgagacttcgtcacacataaaacaagcacgacaaagaaagagggcgcgaagggactcctggaagaaattgagtctacatttaagatcaccctaaaagtagtgacggcctcttcattactccaaaccccagatttaagtcggtaggacgtcttcgcgttgacttgtggggaatgtagtttcgatgctgccggcgcgttttgtttgcgacagaaactacaacccccaggggccaccgcgacgttgcctgtgggtgcccgcgaaccaacggttagcggtggcaggggctgactgagagcgtctgcttgataatggattctgaattaatgcatagtatagtaggaagctatcataaacctccagaaagagtatttgttccctcattcacccagaatgaaccatctcagaattgccatcctgcaaacttagaagttacctctcctaagatacttcatagcccaaatagccaagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaagatataagtatacagttaagctcagcccagtctcgttgtactcttctagagaagcaactagaatatacaaagagaatggttctcaacgtagagcgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaagattaaacatttagaagaaaaacttaaggaagaagaacatcagcgtaagctatttcaagacaaagcttctgagaaaactaaatgtataaagagacgaccaccttggcaaatttgttcaaagtttggagcactgccttttgtggctgaaaagtctaccagtgcaagctgttctgtgaatgcaagtatgcaaaactttttgcagatgaggcaacatcgtgacccacatatccttcagaaaccttttaacgtgactgagactagatgtctccccaagccttctagaacaacttcctggtgtaaagctattcctcctgactcagaaaagtccatttccatttgtgacaatttatctgaacttttgatggcaatgcaagatgagctggaccaaatgagcatggagcaccaagaactactgaaacaaatgaaggaaactgaaagtcattcagtctgtgacgacatagaatgtgaactagagtgtttactcaagaaaatggaaattaaaggagaacaaatctccaaactgaagaagcatcaagacagtgtctgtaaactgcagcaaaaagttcaaaactcaaagatgagtgaagcttcaggtattcagcaagaagacagctaccctaaaggatcaaagaacataaaaaatagccccagaaaatgtttgactgacactaacctttttcagaaaaacagcagctttcatccaatacgagttcataatcttcaaatgaaattgagaagagatgatatcatgtgggaacagtaacaaaacagcaaaactgtcaccttaatgaactttgtcagtgagaccttgaattgtctaaagtggttttaatttaatataactttgtgacattttgaatcatgtttctagtttctataaaacatgaagttgcagtatttaaaaattaatgcctaatgacctggtgggttccaaataataaattaattgcttttttatttttcttattgattgaagcccgtaacctcatcttgtcttagaaacattgttggctttgcagatatcttaagctaaatttaagaaattgtactagattgacaatattcaaaattgagttaaatccaagctacaagtaccattcattccacttttcatttagtaggtttggaaccttaaaaaccaatgttcaatgaacagagaacagaaagataaaaaaaaaaaaa

SEQ ID NO: 301 - DNA, 1506 bp, Homo sapiens
  CDS (293)..(1174)
ggtgcaaaccattctgttactctttcaagccattgaatagtttgagtccattgtttgaattttagttttgaaaaagtgataaattggccatttgatcatcaattaatagcggtatatattacacctgccattgtttttaaatgcctaattaaactgtcaaaacagacacaatgaaatgatagatacataatttgagatttgatcagttgtataaactaattttttaaattttaaaattcagtttaaggtcattaagcttgtcttgtatgtttccctcctccaggaaaaaaaaatgtttatttctttgtgggagttcttctatgggcacttttttcgattttggatgaaatggctattacgacagatgactgggaagtgtgaattgcagcgaatatttgatacctatgtaggtgcacaaaggacacacaggatagaaaattccttgacatactccaagaataaggttttacagaaggcgacacatgttgttcagagtgaagtggacaaatatgtagatgatattatgaaggaaaagaatattaaccctgagaaggatgccagttttaaaatatgcatgaagatgtgcttactgcagataactggttataaacagctgtatttggatgtagaaagtgtgaggaaaaggccatatgattctgataacctacagcatgaagagctactcatgaagctttggaatcttctaatgcccacgaagaagttaaacgctagaatctccaagcagtgggctgaaattggttttcagggtgatgatcccaagacagacttcagaggcatgggcatacttgggttaatcaatcttgtgtatttcagtgaaaattacactagtgaagctcatcagattctttcccgttcaaatcatccaaaattagggtattcttatgcaatagttggaatcaatcttacagagatggcttatagcttactgaagagtgaagctttgaagtttcatctctataaccttgttcctggtataccaacaatggaacactttcatcagttttactgttatcttgtctatgaatttgacaagttttggtttgaagaagaaccagaaagcattatgtatttcaatttgtatagagagaagtttcatgaaaagattaaaggacttttactggattgtaatgtagcacttactttaaaagtataaatcatccactgtatcttctatttctaccacattttgcacattcaacagaatttatatgttgtaataggaattatctgatcaattacactcttatatataatttcctacaaaaatatttcagaaattctatttaagaaagctagtggacaatcagtgtatgtttacaattgtttatacactgttctccaaaggtaccttatccttccaaagatcccctctgtagagtcatgcgaactacagtttggaacttgggacttagcccgttggtgtaaaagtataaatcaggtatttgtattaaattgattaaaatgtgtaaaatcaaaaaaaaaaaa

SEQ ID NO: 302 - DNA, 2095 bp, Homo sapiens
  CDS (119)..(1159)
tttcgtggcgatgcgggggttgacagtcattttatttacttggattcaaacctacaggatgatttttcagcatgggttgggagcaacagtaaaaacatatgggagtttttaaggaccaatgaaacattcagactcacaagatgaacgcaggggacacttggcaccagtctcctcgaaagatttgggacacagcctgacacagcctgccagcaagtttgatggtgacagtgcctacgtggggatgagtgacggaaacccagagctcctgtcaaccagccagacctacaacggccagagcgagaacaacgaagactatgagatccccccgataacacctcccaacctcccggagccatccctcctgcacctgggggaccacgaagccagctaccactcgctgtgccacggcctcacccccaacggtctgctccctgcctactcctatcaggccatggacctcccagccatcatggtgtccaacatgctagcacaggacagccacctgctgtcgggccagctgcccacgatccaggagatggtccactcggaagtggctgcctatgactcgggccggcccgggcccctgctgggtcgcccggcaatgctggccagccacatgagtgccctcagccagtcccagctcatctcgcagatgggcatccggagcagcatcgcccacagctccccatcaccgccggggagcaagtcagcgaccccctctccctccagctccactcaggaagaggagtcggaagtgcatttcaagatctcgggagaaaagagaccttcagccgacccaggaaaaaaggccaagaacccgaagaagaagaaaaagaaggaccccaatgagccgcagaagcctgtgtcggcctacgcactcttcttcagagacactcaggccgccatcaagggtcagaaccccagtgccactttcggtgacgtgtccaaaatcgtggcctccatgtgggacagcctgggagaggaacagaagcaggacttcccgcacatctctgagttccccagcagctcgggatcctgctcacctggcccatccaaccccaccagcagcggggactgggacagcagctaccccagtggggagtgtggcatcagcacctgcagcctgctccccagggacaaatcgctctacctcacctaatcccgcctccctaccatccctgaggctcgctggaaggcactgctcagagcctgaagggctgacagcagaaaagaggccctggccagaggcagggtggcccatcggagagagcagtgacacacccattgcccgggggctgagtctcttcctcaacctcccaccagactctgcagaggcagcccactgcccaccaccagcccaaagaacctgcaggaaccttccgcccgctgacctgcttgctccagggtaactgtggaccctgtcctcgccctgcgcacggtaccctatgtctggacacccggccccagctccagccccagcccaggtgggccgcccctggcggggtcgcttaccaacggacacccaccccagatgcatgggccagagggccggcccccggcatagatgtgcacatcggttttccagtgtgaacaaaagattacgaaacctagaaactgttggttccgtgtaagtagttgactacgtgttttagaactgtgctgaagacatctgtaagactattttgtgggggaaaaaagtagtttcctttaaggtaaaaagcattttatatgatccttagcacatttttaagttttatcttaagggagacgcgcacaaaagcggctgccaaaccgtttcgtcatcctcacagcaaggaccggacgcttgctagccaccccggagcactgctctccttttaatcatgtattcatctattttaaattgccggcgacgacttttgtctatttatgaagaaaccttgagaacgaagttacagcttatcctaccgtgtgtgtggttttggggtttcgtttgggtttgggttcttgacgtcgtttgcagctgtttcctggccctggcgagtgtctgtcttggtgcccagtgcttctctcaaatctctttataataaaacttctgaaaagctgaaaaaaaaaa

SEQ ID NO: 303 - DNA, 5900 bp, Homo sapiens
  CDS (26)..(3163)
cttcccgggtcgacgatttcgtggcatgatgacacagggaagggcagagacacagctagaaacaacacaggcaggtgagaagatacaggaagacaggaaggcccaggcagataagggcacacaggaagacagaaggatgcagggagagaaggggatgcagggagagaaggggacgcagtcagaggggagcgcgcccacagccatggaaggtcagtctgagcaagaggtggtaaccagcctcggcccaccatccagaacccccaaactcccacctacagcgggtcctagagctcctctgaatattgaatgttttgtacagaccccagaagggtcttgtttcccaaaaaaacctggttgcctgcccagatctgaggaggcagtagtaacagcctccaggaaccatgagcaaactgtgctgggtcccctgtcagggaacctcatgctcccagcacagccgccccatgaggggagtgtggagcaggtgggaggagagagatgccgagggccacagtcatcaggcccagtcgaggccaagcaggaggacagcccgttccagtgccccaaggaggagcggccagggggagtgccgtgtatggatcagggtggctgtcctctagctggcctgagccaggaggtacccacgatgccttctcttcctggaactgggctgacagctagcccaaaggcggggccgtgtagcaccccgacttctcagcacgggagcacagccaccttcctgccctctgaggatcaggtcctgatgagttctgccccaacactgcacctggggctggggacccccactcagagtcacccaccagaaaccatggccaccagcagtgagggggcctgcgcccaggtaccagatgtggaggggcggaccccaggtccccggagctgtgaccctggcctcatagattccctgaagaactacctgcttctgctgctgaagctgtccagcacagagacaagtggagcagggggagagtcccaggtgggggcagccaccggaggtctggtgccctcagccactctgacacccactgtggaagtggctgggcttagtccccggacatcgaggcgcatcctggagcgtgtggagaacaaccacctggtgcagagtgcacagaccctgctgctgagcccctgtacctcccgccgcctcaccggcctcctggaccgtgaggtgcaggctggccgccaggcccttgctgctgcccgaggctcctggggtcctggtcccagctccctcactgtccctgccattgtggtagacgaggaggaccctgggctggcctcagaaggagccagtgagggtgaaggagaggtttcccttgaggggcctggcctcctgggggcctctcaggagagcagcatggctggtcgactgggggaggcgggtgggcaggcagcccctggacaggggccctcagcagagagcatagcccaggagccctcccaagaggagaagttcccaggggaggctctgacaggcctcccggcagctacacctgaggaactggctctaggggcccggaggaagagatttctccctaaggtcagagcagcaggagacggggaggcaaccacacctgaagaaagggagagccccacggtttccccccgggggcccaggaaaagcctggtgcctgggtccccagggactccagggcgggagagacgctcccctacgcagggcagaaaggcgagcatgctggaggtgcctcgggcagaggaggagctggcggcaggagacctgggccccagccccaaggccggcggtctggacacagaggtggccctggatgaaggcaagcaggagacactggccaagcccaggaaagccaaagacctgctgaaagccccacaggtgatccggaagattcgggtggagcagtttcctgatgcctccggtagcctgaagctgtggtgccagtttttcaacattcttagtgactcagtcttgacatgggccaaggatcagcgcccagtgggcgaggtgggcaggagcgcaggggatgaggggccggcggccttggccatcgtgcaggcctcccccgtagactgcggtgtgtatcggtgcaccatccacaatgagcacggctcggcctccaccgacttctgcctcagccctgaggtgttgtcaggattcatctccagagaagaaggtgaagttggagaagagattgagatgacccctatggtgtttgctaagggtctggctgactctggctgctggggggacaagctctttgggcgactggtaagcgaggagctccgagggggtggatatgggtgtggccttcggaaggcctcccaggccaaggtcatctacgggctggaacccatcttcgagtcgggccgcacgtgcatcatcaaggtgtccagcctgcttgtgtttgggcccagcagtgagacttctcttgtgggcagaaactacgacgtcaccatccaggggtgcaagatccagaacatgagtcgggagtactgcaaaatcttcgcagcagaagcccgggccgcgcctggctttggggaggtgcctgagatcatcccactgtatctgatctaccggcctgcaaacaatatcccatatgctaccctggaggaagacctgggcaagcccctggagtcttactgttctcgggaatggggctgtgctgaggctccgacagcatctggcagctctgaggccatgcagaaatgccagaccttccaacactggctgtatcagtggacaaatggcagcttccttgtcacagacttggcaggggttgactggaagatgactgatgtgcagattgctaccaaactccgaggataccagggcctcaaggaaagctgcttccctgccctgctggaccggttcgcctcctcccaccagtgcaatgcctactgtgagctgctggggctgacacctctcaagggcccggaggcggcccacccccaagccaaagccaaaggctctaagagtccatctgctggcaggaaaggctcccagctgagtcctcagccccagaagaaaggcctccctagtcctcagggcacccggaagagtgctccaagttccaaggccacccctcaggcctcagagccagtcaccactcagttgttgggacagcctcccacccaagaggagggctccaaggcccagggcatgcggtagcctccgcagaggctgggggcctccacccagcagcagaccaaccaggaagcagcttgaactggatggagactttccaaatatggaactaactggagaaggtgcacgaaggagacaccacttggggacctctctgagcaggctctcgtgaatcaactcgtcatcagatggctttggtgcatggcacatagcccactggcctcttctggtgccactgtcacccagggctcccgggcctcaagcagtccccacctccgagtgcctggcaacctaggccctccttgaagtttacactttgccactgctggaggctcccctgagtcctctgcatgagttctgcaccccaagcccttgccccagcccagtccagcagcagatgttacaatctgagtgaggacatgcaggccaacttttaccctcctgcatttgcctggccctgatctcgcctgtactcagggatccagacttcctctgctggtctggcctggtgactctcagggtatcttctccttccagctactttcgctcactgatctcagcttatcctgcaactaaccatccttgagcccagatggggctcagggcccttccagagcctgtcatgtccttgtgcagtggcctttgatgtgtgttcacgctcttcccccttcactcactcgcctgcttcccatgctcccttgtaccccctcgccacatccctgtcttggggcccagctgcagcctgctgcctgcccttcatggctctgcacatggccctttgcttgagggctccccactccctgcccaccaatacccaggtgaggaacagaccctctggcctctcaccccacttcagtgctctcttccccaacttctctcgggctctttgctcatgaggtgagagctggtgtgagggttgtgtcagcagctgtagccagagagaggtgttgactctgagagaccttgcactccatactgaaaggaggtggggtcacagtgaatttcacatcccctctcaaccaggagtggagggctaggtcccttccccatggggagtacacttgggtgttctaggagggatgcagtctatccatgcacttgggtggaggggagtctctgtgcctgggaattaggacccctgctccaaccatcgctcttgatcctggggccccagctctgggtcctcatgtatgggctcccaaggacccagcagcctggatccttccagagcatccctcctggaggcctgggatggggtaggtctgcagctagcctactccctttggaatgcaataaaggcagcattgtgtgccctgcttgccctcatctggtgtggttggaggtctgtggagtcaaggtccccctctcccaggcaggctctctgagggcattctgtagtcccaggcccactggaaaaatgaatctatattttggttcctggaccgaagttcagtcgcagccttctgtggccacagaaagacagcttgtgctgcttgcacaactgagctgctggtgtgtaccccttagcagggtgtctggggacttacgcctttggaattgctcttcattcagaagaggaacacaaaggaagccacccaggaaggaagcacagagctgggggctctggaaacgccctgtgtctctggctacagcaagaccagcccaggagcccaccagcacctgcctctcagctacttgctgaccatttcctgcttctcaagctgcagagaagcttttcattcccacccccacccggaacctccccttgcctaacatttcccctctatggtaacatctctgacttctctacctcctctgtgctcaggtgactccacatcttctgccccagtgtgtccccacctctcccagcctgtatacccagattactttggtgaactgagagctggagtactgttcattcatttattcattcacccactcattcagcagaccttggcattttcacatgatttatctcccactctgattcacatatgtttgaccaaggcactgggcagctgccaatttcccgtcccttctgtagtcccagatgaatggatacagacctctttggggaaggctgcaaggaaggttcacaacatgcatctaagtgttaaaataagtttttccttcaaaaatacatttgacttcctctccatttaaggtctggaaatcaagtgggagatcttgactttaccttggcacttgagacagaactgttggcccagaagtctttagttaaggtcattactaggccatatcttaggggcgtctggcctttttcattcctgggacccacagctcgaggtctggtttccatgccctatcccttacgatgagcgccctattttgttccttctgtctatctctgttgctgagatcagggagcccacgttcacagcagctctttcaagcagcctcccaggcctagagaggaaaatcagcagagcctcgtgaatgtatttctcgtggcaagaagggagctcatcttctgggtcctgccagagggcagtgagggggttgatgggctgggtgcatgccagggacccaatcaagcatttttatcttctgaaatctttgaattcctgcctttcttggatgtttggtcttttgatataatttagcatgggccaacatttggtccagatttgtattagccaagccctcctaaaatagtaataacagtatctggcgatttgagcttttacgtagaatgtagaatctctggtgagtgaacatatcaataaagacaacctgaacc

SEQ ID NO: 304 - DNA, 872 bp, Homo sapiens
  CDS (162)..(521)
tttcgtgcgtaggaggggtcggaggtcttacccaacagattgacgcggcgttagtattggccgtgtacccgaaaaactgattgactgggctggcgttaactgtgcggaggcaggatttccctggggaaagtcttcactcagagcttcgctgacagccaaggatggcaagcaaggggccctcggcctctgcatctcctgagaactccagtgcaggggggcccagtgggagcagcaatggcgctggcgagagcggagggcaggacagcactttcgagtgcaacatctgcttggacacagccaaggatgccgtcatcagcctgtgtggccacctcttctgttggccgtgtttacatcagtggttggagaccagacctaacagacaggtgtgtcctgtttgcaaagctggcatcagccgagacaaggtcatccccctctatggaaggggcagcactgggcaacaggaccccagagagaagaccccgtcctcgtcctcaaggacagaggccagagccggagaatagagggggatttcaaggatgtggctttggagatggtggcttccagatgtcttgtgaagtcggggcatttccctgtggatattgtgccacagcatttactctcccttgactgggcggtcgtcctccagtctgtcccctgggaccacccccagtattgtgggaccgaggcagtccctgtcacggcctcgttcctaattttggtggcctgggcggagtccattggtactgggtccctggttgccttaagggtggcgccctggctacattcgtgggcagggtcttggcaggggcgtgcacccccaactcccggtggttgggcgcctgggacacttggtccgggcacccgggtttgcc

SEQ ID NO: 305 - DNA, 7861 bp, Homo sapiens
  CDS (458)..(6442)
atcagacaggcaaaggcccagagaaagcagcttcatgactttgtggccaggggcacagtcctttcttactgtgaaactttactagaacccgaatgttcttcaagggttgctggcaggcctcagtgtaaacaaatagaccagtcatcatcagaccagaccaggaatgagggtgaagcaccgggatttcatgtggcatctctatctgctgaagcagggcagatagatctgttacctgatgagaggaaagtccaggccacatctctgtctgcagacagctttgaatctctgcccaatacggaaactgacagagagccatgggatcctgtgcaggctttctcccatgctgctcctgctcaagacaggaaacgtcgtactggagaactgaggcagttcgcgggagcaagtgaaccatttatatgtcactctagttcttctgaaatcatagagaaaaaaaaagatgcaaccagaacaccttcctcagctgatcctttggccccagacagtcctcgttcttcagcacctgtggagggaggtcaggagggtagtatcaaagaaggtagtggctgccttaccttctcaggccccttatgatgatcctagagtgactctgcatgagctaagtcagtcagttccgcaggagactgcagagggcataccccctggcagtcaggacagcagcccagagcatcaggaacccagaactctagacaccacatatggagaagtttcagataatttgttagtgactgcacagggagaaaaaacagcccattttgaaagtcagtctgtgacctgtgatgttcagaattctacaagtgcctcagggcctaagcaagaccatgtccaatgccctgaggcttctactggctttgaagaaggtagggcaagtcccaaacaagataccattctgcctggagctctgacaagggttgcactggaagctcccacacagcagtgtgtgcagtgtaaggagagtgttgggtctgggttgacagaagtctgcagggctggcagcaaacattccaggccaattccactgccagatcaaagaccaagcgcaaatcctgggggaattggggaggaagccccatgtagacacccaagggaagctttagatggccctgtcttctcaaggaaccctgaaggcagcaggactctcagcccgtctagagggaaagagagcagaactcttccttgccgacagccatgcagttctcaacctgttgctactcatgcttattcctcccattcctctactttactgtgttttagagatggtgacctagggaaggagcctttcaaggctgccccacatactatccacccaccctgtgtagtaccttccagggcctatgaaatggatgagacaggagagatctctaggggacctgatgtgcacttgacacatggccttgagcccaaagatgttaacagggaatttaggctaacagagagcagcacttgtgagccttctactgtggctgctgtcctatctcgagctcaaggctgcagatccccttctgctcctgacgtgaggacaggttccttcagccactcagctactgatggaagcgtggggttaataggggttcctgagaaaaaggttgctgagaagcaagcaagcacagaacttgaggctgcctctttccctgcaggcatgtactctgagcccctgaggcagtttagggacagctctgtaggtgaccagaatgcacaggtgtgtcaaaccaatccagaaccacctgcaacaactcagggaccacacaccctggatttaagtgaagggtctgctgggagcaagttggtggtagagccacagcatgaatgtttagaaaataccactagatgttttttggaaaagccacaattttccactgagttgagggatcacaatcgcttggattcccaagccaagtttgtagcaaggttaaaacatacctgcagcccccaggaagacagtccctggcaggaagaagagcagcacagagaccaggcttcaggtggtggagaaggcttcgcccagggtgtgaatccccttcctgatgaagatggcttagatggctgtcagattttagatgctgggagagaggaggtggctgtggccaagcctcctgtgtccaagattttatcacagggcttcaaagacccagccactgtgtccttgaggcaaaatgaaacaccgcagcctgctgctcagaggagtggccacctctacactggcagagagcagccagcacccaaccacaggggctcacttcctgtgactacaatcttctctggccccaaacactccaggtcctcccccacaccacagttctcagttgtcggctcttctcgttctcttcaggagctgaacttgagtgtggagcctccttcccctacagacgaagatacacaggggcctaacagattgtggaacccacatctcaggggctattcctcaggaaagtcagtggcaagaacatctctgcaggctgaggacagcaatcagaaagcctcatctcgcttggatgatgggactaccgatcacaggcacctgaagcctgccacccctccttatccaatgccttccactctctcacacatgccaacccctgatttcacgaccagctggatgtctggtactttggaacaagcccaacagggaaagcgagagaaactgggtgtccaggttaggccagaaaattggtgctctcagatggacaaaggaatgctgcactttggctccagtgacatcagtccctatgcgctgccgtggcgtccggaggagcctgcacgtatcagctggaagcagtatatgtctggcagtgcagtcgatgtttcctgcagccagaagccccaggggctgacactatcaaatgtggcccggtgctccagcatggacaatggcctagaagaccagaactcccctttccactcccacctcagcacttacgccaatatttgtgatctgtcaaccacacacagcagcactgagaatgcccagggttcaaatgaggcctgggaagtattccgagggagttcttcaattgccttaggagacccccacatcccgacgagccctgaaggagtagcccccacttcgggtcatgacagaaggcctcagttcaggggcccttctggtgaagcagactgtctgaggagtaagccccccttggccaaaggaagtgctgcaggtccagtggatgagattatgctgctgtatccatcagaggcaggctgccctgtgggacagaccaggacgaacacattcgaacagggcacacagaccctcggcagcaggcgccactggagcagcactgacatctcctttgctcagcctgaagccagtgcagtatcagcctttgatctggcctcatggaccagcatgcacaatctgtctctccacctctcacagctcctgcacagtacctcagagctgcttgggagtctctcccagccagatgtggccagaagggagcagaacaccaagagggacatcccagataaagccccacaggccctgatgatggatggctctactcagaccactgtggatgagggcagccagactgacctcaccttacccaccctgtgcctccagacttcagaggctgaacctcagggagccaatgtgatccttgaagggctaggctcagatacctcgactgtgtctcaagaagagggagatgtgccaggggtacctcagaagagagaggcagaggaaacagcacagaaaatggctcagctcctctatcttcaggaagaaagcactccctacaagccccagagcccttcaataccctcatcccacttgaggtttcagaaagcccccgttgggcagcatcttccttctgtgagcccctcagtttctgatgctttcctgcctcccagctcccagccagaggagtcatattgcttagttgtcagcagtcccagtcccagctcccctcattccccagggctctttcccagtacttccgagtatcctggggactccagggtccagaagaagctgggccccacaagtgctttgttcgtggacagggcctcctccccaatcctcactcttagtgccagcacccaagagccgggtctttccccaggctctttgaccctctcagccccttcaactcaccctgttgaaggccaccagaagcttgactccagcccagaccctgttgatgccccaaggactccaatggataattattcccaaaccactgacgagttaggtggctcccagagaggtagaagttccttacaaaggagtaatgggagatccttccttgagttgcactccccacacagcccacagcagagtccaaaactccaatttagtttcttagggcagcaccctcagcagcttcagcccaggacaactatcggggtccaaagcagactgctgccaccaccactgaggcacaggagccaaaggctgggcaacagctttgtgcctgagaaggtggcttccccggagcattgcccactgagcggtagggagccaagtcagtggcagagcaggacagaaaatggaggtgagagttcagcatctccaggggaaccacaacgcactctggaccgaccttcttcatggggaggcctccagcacctcagcccctgccctgtctctgagttgactgatactgcagggctccgaggttctgccttgggcctccctcaggcctgccaacctgaggagttactgtgcttcagttgccagatgtgcatggcccctgagcaccagcaccacagtctgagggacctcccggtgcataacaaatttagtaactggtgtggggttcagaagggctcacctggggggttggacatgactgaggaggagctgggggccagcggtgatctcagctctgaaaagcaggaacagagtcccccacaacctcctaatgaccacagccaggattctgagtggtccaagagggagcagatccccctgcaagttggggcccagaacctctcactcagcgtggaactcacagaagcgaaactgcaccatggctttggggaggccgatgccctgctccaggtgctgcagagtgggacaggggaggcgcttgctgctgatgaacctgtgacatccacctggaaggagctctatgcacggcaaaaaaaggccattgagaccctcaggagagagcgggctgagcgacttgggaacttctgccggacgcgaagccttagccctcagaaacaactgagcctcctgcccaacaaagatctcttcatctgggatcttgacttgcccagcagacgccgagaatacctgcagcaactgaggaaggatgttgtggagaccaccaggagcccagagtcagtgtcaaggtcagctcacacaccctctgacatagagttgatgctgcaagactaccagcaggcccatgaggaggccaaggtggagattgcccgggcccgagaccaactgcgggagcggactgaacaagagaagctgagaatccaccagaagatcatttcccagctattgaaggaagaggataaactacataccttggccaattccagctccctgtgcaccagctctaatggaagcctctcgtctggcatgacctctggctataatagcagcccagccttgtcaggccagctccagttcccagagaatatggggcatacaaacttgcctgattccagggatgtatggataggggatgagcgaggaggccattctgcagtgaggaagaactctgcctacagccacagagcctccctgggcagttgctgctgttcaccatccagtctgtccagcttggggacctgcttttcctcctcctaccaggatttggccaagcatgtcgtggacacttctatggctgatgtaatggctgcttgttcggataatttgcacaacctcttcagctgccaggcaactgctggctggaactatcagggtgaggagcaggcggtgcagctttactacaaggtgttttctcccactcggcatggcttcctgggggcaggtgtggtgtcccagccgctgtctcgtgtgtgggcggctgtcagtgaccccactgtgtggcccctgtattacaagcccatccagacagcaaggctgcatcagcgagtgaccaacagcatcagcctggtgtacttggtgtgcaacaccaccctgtgcgcactgaagcagccacgggatttctgttgtgtctgcgtggaagccaaagagggtcacctgtctgtcatggcagcccagtctgtgtatgatacatccatgccaagacccagcagaaaaatggttcgcggggagatcctgcccagtgcctggatcttgcagcccatcactgtggaagggaaggaagtcaccagagtcatctacttggcccaggtggaacttggtgctccaggcttcccacctcagctcctgagctctttcatcaaacggcagccactggttatagccagactggcttccttccttggtaggtagcatctcaccgtcaagatggtgctgctgagatgcaggcccaggctgctcaagagagacactgtggcagctccttgttactttccataccacagtgcaggaaaagctgatgctacctgctgtggccgattggggcagacagcactggcccagggatgctagcaaagcccagtcagtacttggtcacagctggcaccagtgcagagcaaacggcctgagctcctggcccagactatccagagtgaatgcagctccgctcaccttttggatttctcacctttctttcctgtttctgggactctgcggcagacaggacacttaaggaccaggactgggcacagccagcagagccggggactgcagtgctttggcaaggtgcttccgcaggctggtagggaagcaggcagccactggccaagactctgctctgaatctacctcctctagcattcagctctactgtgtgatgggacgttaaaaataccaaaacagaaagagggtttaagaaacagctgcacaaaccagaacaccgattcagaatcttttctccctcttgagtttttgcaaaatactttattattgatttttgctttttttctccctttccctcccaggagaagacatttgggtcttggcctgaggcaggggtgttgagcgatgatgctctgatatggagctgtcactctagagctcggtcagatggaagacactatagaaccaggttggacagatttggggtcagggttggaggctgagttcttttgaggactggttggagtggcagccagatggtggctgctgacaaggcaagaggaatttcagagattaaacattgtcctttgaggaagggagaggaggtgaatgaactcccagaggaggtgagtggcttgttgggaggaagctcagttccagaacttacctcagtgcacttgggaggggtggagtcctgagcattccatgatttctgccctggccccacctatcctaggatggggtgggatggagagtgggttcagttttcttgtactttagcctggctgaacatgaactttgtgtttacctggaagtggtaggggtgggagagattctcatctttagttctggtgcccaaaatctttggtagatggagggaactggggattcagaagatgtggtaaaggtctatttctgtagtgtggcagagatgtgtttttctaaagtgtttgcagggcatttttccctcttacctcagattaagttatttatatattgttgattgaaggttttttaaaattgcttttaaacttctatttctcgggtaaattttttggtgacatgatatatttaacaccctatttatatactcctacctcttttcatataaatctcttactaagactactgaccaaaaaagaacattttaaaattaaaaaaaaaaaaaaaa

SEQ ID NO: 306 - DNA, 1035 bp, Homo sapiens
  CDS (593)..(886)
cccttttcatatttctcatatccgatctcacacacaacttcctggggccactatctctaggtaatgatagagcagataaattcatcagttctatatttcaacaagcccaagcttcccatgctttactgcatcagaacaacttgcccttactcgtatgtttcatctgcctcgcagccaggcttgagttattgtgcaagcctgccccacttgccagcatgtccctggtgttgcacctgtggaaggatgcaacccacgaggcttggctccaaatgaaatctggcagatggatgttacatatatatagcagcctttggctaactccgctatgttcatgtaatatagacacttactcccatatgttacatgccacatgccaaactggggaaacagctggtcatgtctgacgatactgtctgtcgtcatttgcccatatgggggtccctaaacaatttaaaactgacagtggactcgcttatgttagtcatgctttcccaattttttacaattgtgggcaatcaatcataaaacaggaattccatacaatccctgagggccaggcattattgagcgggtacatcaaacactacaacgcatgctgaaaaaaaaaaaagggagaataggggaccaattaccacttcaaacaaaattacatttagccttgtttactttaaattgtttgactcctggtacggatggcaagaccccagcagaacgacactggcaactgctagaggaaaagaggcaagtttatccaaaagtgttatggaaatccccagaagaaggacaatggaaaggtccggtggatttgctgacgtggggacgagggtatgcttgtgtttttacaggagatggacaaaccgtgtgggtgccctccaggtgtgtgtgaccatggaacgggagaccggagggatccatggtattcaaccgtgggcctgttaccttccagtacgagccatgagccagcggaatctgaatgcaaagacagaacaagggccgaccggagtcacaatgacatccaaccccataacatgggga

SEQ ID NO: 307 - DNA, 3694 bp, Homo sapiens
  CDS (424)..(3597)
gataccgctccggaatttccgggtcgacgattctcgagccgacccacggagtcttgtctcctgcttgtgggtggaggggagcttccgaaggaggccagcgaagaaccctgcaaagcggtgaggacccagcatccggcccctcgcccctggcgagcaaacgggtcagaccgttaggcacagcctccttgtggagcgcacggacaggaagcagggtttatagcacctagagggggaaggagtggcaagtgcggagggcagcccctcccaggactagaacccacttcctactttacaccagcactggaggaggctggtggggcagggcgggggcggtggggcctcccctagccttccctccccctctccttcactgtccttccagcaggcacaggaaggtgaggcaaggtgtttccagccggcaggatggaggacgaggaaggccctgagtatggcaaacctgactttgtgcttttggaccaagtgaccatggaggacttcatgaggaacctgcagctcaggttcgagaagggccgcatctacacctacatcggtgaggtgctggtgtccgtgaacccctaccaggagctgcccctgtatgggcctgaggccatcgccaggtaccagggccgtgagctctatgagcggccaccccatctctatgctgtggccaacgccgcctacaaggcaatgaagcaccggtccagggacacctgcatcgtcatctcaggggagagtggggcagggaagacagaagccagtaagcacatcatgcagtacatcgctgctgtcaccaatccaagccagagggctgaggtggagagggtcaaggacgtgctgctcaagtccacctgtgtgctggaggcctttggcaatgcccgcaccaaccgcaatcacaactccagccgctttggcaagtacatggacatcaactttgacttcaagggggacccgatcggaggacacatccacagctacctactggagaagtctcgggtcctcaagcagcacgtgggtgaaagaaacttccacgccttctaccaattgctgagaggcagtgaggacaagcagctgcatgaactgcacttggagagaaaccctgctgtatacaatttcacacaccagggagcaggactcaacatgactgtgcacagtgccttggacagtgatgagcagagccaccaggcagtgaccgaggccatgagggtcatcggcttcagtcctgaagaggtggagtctgtgcatcgcatcctggctgccatattgcacctgggaaacatcgagtttgtggagacggaggagggtgggctgcagaaggagggcctggcagtggccgaggaggcactggtggaccatgtggctgagctgacggccacaccccgggacctcgtgctccgctccctgctggctcgcacagttgcctcgggaggcagggaactcatagagaagggccacactgcagctgaggccagctatgcccgggatgcctgtgccaaggcagtgtaccagcggctgtttgagtgggtggtgaacaggatcaacagtgtcatggaaccccggggccgggatcctcggcgtgatggcaaggacacagtcattggcgtgctggacatctatggcttcgaggtgtttcccgtcaacagtttcgagcagttctgcatcaactactgcaatgagaagctgcagcagctattcatccagctcatcctgaagcaggaacaggaagagtacgagcgcgagggcatcacctggcagagcgttgagtatttcaacaacgccaccattgtggatctggtggagcggccccaccgtggcatcctggccgtgctggacgaggcctgcagctctgctggcaccatcactgaccgaatcttcctgcagaccctggacacgcaccaccgccatcacctacactacaccagccgccaggtgcccccggctgtcccagtgccaccacagtgggctgacaagaccatggagtttggccgagacttccggatcaagcactatgcaggggacgtcacgtactccgtggaaggcttcatcgacaagaacagagatttcctcttccaggacttcaagcggctgctgtacaacagcacggaccccactctacgggccatgtggccggacgggcagcaggacatcacagaggtgaccaagcgccccctgacggctggcacactcttcaagaactccatggtggccctggtggagaaccttgcctccaaggagcccttctacgtccgctgcatcaagcccaatgaggacaaggtagctgggaagctggatgagaaccactgtcgccaccaggtcgcatacctggggctgctggagaatgtgagggtccgcagggctggcttcgcttcccgccagccctactctcgattcctgctcaggtactggcacctgacacccatcactccatgggccatagtccctgtgtggagtccaaggggcctgggccacactgccctgtcctgtggtgacaggtacaagatgacctgtgaatacacatggcccaaccacctgctgggctccgacaaggcagccgtgagcgctctcctggagcagcacgggctgcagggggacgtggcctttggccacagcaagctgttcatccgctcaccccggacactggtcacactggagcagagccgagcccgcctcatccccatcattgtgctgctattgcagaaggcatggcggggcaccttggcgaggtggcgctgccggaggctgagggctatctacaccatcatgcgctggttccggagacacaaggtgcgggctcacctggctgagctgcagcggcgattccaggctgcaaggcagccgccactctacgggcgtgaccttgtgtggccgctgccccctgctgtgctgcagcccttccaggacacctgccacgcactcttctgcaggtggcgggcccggcagctggtgaagaacatccccccttcagacatgccccagatcaaggccaaggtggccgccatgggggccctgcaagggcttcgtcaggactggggctgccgacgggcctgggcccgagactacctgtcctctgccactgacaatcccacagcatcaagcctgtttgctcagcgactaaagacacttcgggacaaagatggcttcggggctgtgctcttttcaagccatgtccgcaaggtgaaccgcttccacaagatccggaaccgggccctcctgctcacagaccagcacctctacaagctggaccctgaccggcagtaccgggtgatgcgggccgtgccccttgaggcggtgacggggctgagcgtgaccagcggaggagaccagctggtggtgctgcacgcccgcggccaggacgacctcgtggtgtgcctgcaccgctcccggccgccattggacaaccgcgttggggagctggtgggcgtgctggccgcacactgccagggggagggccgcaccctggaggttcgcgtctccgactgcatcccactaagccatcgcggggtccggcgcctcatctccgtggagcccaggccggagcagccagagcccgatttccgctgcgctcgcggctccttcaccctgctctggcccagccgctgagcgcccgcacccgccgcaccccgaggccgccaattgtccgccccgccagcgctgcaaataaaccttctgagtcagcaaaaaaaaaaaaaaaaaaaaa

SEQ ID NO: 308 - DNA, 1964 bp, Homo sapiens
  CDS (147)..(1295)
gccgggaaggtcacttccggcctgggcgcccgtccccctgaccccagggtctgagtcgccgctgccgccgctgccaccatccgcgaggcaggagagaggaggaggagtgcggcgcggcggccccgggaccaaggagggacccagacatggagctgcgggaagaagcctggtctccggggccgctggattctgaggaccagcagatggccagtcacgagaacccagtggacatcctcatcatggatgatgacgacgtccccagctggcctcccaccaagctgtccccgccccagtctgcgcccccagccggcccgcctccccggccgcggcgccccgccccctacatctgcaacgagtgtggcaagagctttagccactggtccaagctgacgcggcaccagcgcacgcacaccggcgagcggcccaacgcctgcgccgactgcggcaagaccttctcgcagagctcgcacctggtgcagcaccggcgcatccacacgggcgagaagccctacgcctgcttggagtgcggcaagcgcttcagctggagctccaacctcatgcagcaccagcgcatccacacgggcgagaagccctacacctgccccgactgcggccgcagcttcactcagagcaagagcctggccaagcaccggcgctcgcacagcggcctcaagcccttcgtgtgcacgcgctgcggccgcggcttcagccagcccaagagcctcgcgcgtcacctgcggctgcacccggagctgtcggggcctggcgtggcggccaaggtgctggcggctagcgtccggcgggccaaggggcccgaagaggcggtggcggcggacggcgagatcgccatccccgtgggcgatggcgagggcatcatcgtggtgggcgcgccgggcgagggggccgcggccgcggcagccatggcgggcgcgggggcaaaggccgcggggccccggtcgcggcgcgccccggcccccaagccgtacgtgtgtctggagtgcgggaagggcttcgggcacggggccgggctcctggcgcaccagcgggcccagcacggggacgggctcggggcggcggggggcgaggagccggcccacatctgcgtggagtgcggggagggcttcgtgcagggcgccgcgctccggagacacaagaagatccacgcggtgggcgcgccctcggtctgcagcagctgcggacagagctactaccgcgcgggcggggaggaggaggacgacgacgacgaggccgcgggcgggcggtgccccgagtgccgcgctggggagggccggtaggggaggggcccgggggggggcgggcagggcccctcgggcttggcgggagcgacgacgtgcaagaccaagagacccagggagaagcggacggggtgcgatggaccccgcggcatccccggctccccgccctcctctgtccctgcgccgtccgtgggggggcactggggcgtattagggcccgttcacttctccgcctcgagactctgccccctcagcctggcccgcccttcctaagttatcggcctgcgagccggagagacaatggagagaactgcagaggccgagtggcgaccaggccccaagcggaaggccattttccctgcccttcctcagttgtccggggcgggggtggggggtgctgcgaggaatggagaaaccaggccctttagaggatcccagagagggaagagaaccaggggcccttttctcttttagaattttcttttaatcagcccaccttttgactccccgcccgccccaatccattatttttttctgccttccgggtcccatccttagagctcgagtcgttccttcccctcctggattccgggtaggagaggcagcgccgcaggaggcgggtgcccgtttgtcccaggcctgggcgtggtggaggaaggggtgctggaacaataaacggcactatccaaatgtcaaaaaaaaaaaaaa

SEQ ID NO: 309 - DNA, 2200 bp, Homo sapiens
  CDS (74)..(895)
aattcccgggtcgacgatctcgttgcatctttacttgtggagctgtggcaagtcctcatatcaaatacagaacatgatcttcctcctgctaatggtgagcctggaattgcagcttcaccagatagcagctttattcacagtgacagtccctaaggaactgtacataatagagcatggcagcaatgtgaccctggaatgcaactttgacactggaagtcatgtgaaccttggagcaataacagccagtttgcaaaaggtggaaaatgatacatccccacaccgtgaaagagccactttgctggaggagcagctgcccctagggaaggcctcgttccacatacctcaagtccaagtgagggacgaaggacagtaccaatgcataatcatctatggggtcgcctgggactacaagtacctgactctgaaagtcaaagcttcctacaggaaaataaacactcacatcctaaaggttccagaaacagatgaggtagagctcacctgccaggctacaggttatcctctggcagaagtatcctggccaaacgtcagcgttcctgccaacaccagccactccaggacccctgaaggcctctaccaggtcaccagtgttctgcgcctaaagccaccccctggcagaaacttcagctgtgtgttctggaatactcacgtgagggaacttactttggccagcattgaccttcaaagtcagatggaacccaggacccatccaacttggctgcttcacattttcatcccctcctgcatcattgctttcattttcatagccacagtgatagccctaagaaaacaactctgtcaaaagctgtattcttcaaaagacacaacaaaaagacctgtcaccacaacaaagagggaagtgaacagtgctatctgaacctgtggtcttgggagccagggtgacctgatatgacatctaaagaagcttctggactctgaacaagaattcggtggcctgcagagcttgccatttgcacttttcaaatgcctttggatgacccagcactttaatctgaaacctgcaacaagactagccaacacctggccatgaaacttgccccttcactgatctggactcacctctggagcctatggctttaagcaagcactactgcactttacagaattaccccactggatcctggacccacagaattccttcaggatccttcttgctgccagactgaaagcaaaaggaattatttcccctcaagttttctaagtgatttccaaaagcagaggtgtgtggaaatttccagtaacagaaacagatgggttgccaatagagttattttttatctatagcttcctctgggtactagaagaggctattgagactatgagctcacagacagggcttcgcacaaactcaaatcataattgacatgttttatggattactggaatcttgatagcataatgaagttgttctaattaacagagagcatttaaatatacactaagtgcacaaattgtggagtaaagtcatcaagctctgtttttgaggtctaagtcacaaagcatttgttttaacctgtaatggcaccatgtttaatggtggttttttttttgaactacatctttcctttaaaaattattggtttctttttatttgtttttaccttagaaatcaattatatacagtcaaaaatatttgatatgctcatacgttgtatctgcagcaatttcagataagtagctaaaatggccaaagccccaaactaagcctccttttctggccctcaatatgactttaaatttgacttttcagtgcctcagtttgcacatctgtaatacagcaatgctaagtagtcaaggcctttgataattggcactatggaaatcctgcaagatcccactacatatgtgtggagcagaagggtaactcggctacagtaacagcttaattttgttaaatttgttctttatactggagccatgaagctcagagcattagctgacccttgaactattcaaatgggcacattagctagtataacagacttacataggtgggcctaaagcaagctccttaactgagcaaaatttggggcttatgagaatgaaagggtgtgaaattgactaacagacaaatcatacatctcagtttctcaattctcatgtaaatcagagaatgcctttaaagaataaaactcaattgttattcttcaaaaaaaaaaaa

SEQ ID NO: 310 - DNA, 1310 bp, Homo sapiens
  CDS (413)..(673)
ttaaatatcccacattgtgacacattttgagagaattaagcttctgtagtttcaaaccttttatcagatagattaaaatattataatattaaagttattcattggtaaatataattgttataaatgataatgtatatgtttaacaattatcaagacagtagctaatagtaaatataattcgtagtaaaataaatctttctttttcctctttattttagttaagtatgagagagaagctagtaaatactgggacacattttacaagattcataagaataagtttttcaaggatcgtaattggctgttgagggaatttcctgaaattcttccagttgatcaaaaacctgaagagaaggcgagagaatcatcatgggatcatgtaaaaactagtgctacaaatcgtttctcaagaatgcactgtcctactgtgcctgatgaaaaaaatcattatgagaaaagttctggttcttcagaaggtcaaagcaaaacagaatctgatttttccaacctagactctgaaaaacacaaaaaaggacctatggagactggattgtttcctggtagcaatgccactttcaggatactagaggttggttgtggagctggaaatagtgtgtttccaatttttgaacactttggagaactctccggagtcctttctgtattgttgtgattttgcttctggagctgtggagctcgtaaagtcacactcgtcctacagagcaacccagtgttttgcctttgttcatgatgtatgtgatgatggcttaccttacccttttccagatgggatcctggatgtcattctccttgtctttgtgctctcttctattcatcctgacaggatgcaaggtgttgtaaaccgactgtccaagttactgaaacctgggggaatgctgttatttcgagactatggaagatatgataagactcagcttcgttttaaaaagggacattgtttatctgaaaatttttatgttcgaggagatggtaccagagcatatttctttacaaaaggggaagtccacagtatgttctgcaaagccagtttagatgaaaagcaaaatctggttgatcgccgcttacaagttaataggaaaaaacaagtgaaaatgcaccgagtgtggattcaaggcaaattccagaaaccattgcaccagactcagaatagctccaatatggtatctacactcctttcacaagactgaactttgtaacatgttaaggtacaaagccagaggactgtgctattcaaggactactgtaagtctattgtttctcaaaagacaatgagaaaaaaaaaaaaaaaa

SEQ ID NO: 311 - DNA, 905 bp, Homo sapiens
  CDS (33)..(632)
gaagctcacgttctgacctgcagttccctgtgatgaacttcaagagggaacttactgggggaactcaccaccaatatttcaacgaccacgctggacacgcagttcgcgtgcggccgctccccgagcagtgcgcggcgtgggcggaggagcggctccgcgaggagatcgaggcaaacgcggcgcccgcgctgctggaaatcgtggacgcggcggacgccgagcacctggtcacgctccaggacctggacatccgccacggcgacggcttcgcggtgctccggggcgtgtgcagcgaggcctcgttcccggccgtgaggccgctgcgcgagcgcctgcgcgggctgtgggaacccggggccgtcctgctggtgctggtgggcacccaggccgaccgggactccgagcgccaggtgctgatggcgcgggcccgcgaggggccctgcccgttcccgggggtcacggccaagatccagcggaggatggaccaggtgttcacgctggcggtgcgcgagacggaggccctgatcccgcccgagggtgtccctgaccgagctggtctcggcaagtggcgcccaacatgggggctcgaatccgggtcaaagggtcgccggagcgatggttggagaacgtgaaactaaactggaggacacccgagtactcttaaagcaatccccgtgagccaggagagcgtatagcacagctcctgattgtgccgtgagagcggacagggcgatggcaggttcgccgggtgtgaggcttcacagcggtccagggaccaagtcgagatggtgaaaacaagaccaagattggaaagccagcttcagaagagggaattacagcaaaaattgaaccattgacagaagagtctagcagtctcagagagaatgttctccaggattctgaag

SEQ ID NO: 312 - DNA, 608 bp, Homo sapiens
  CDS (83)..(439)
ccttcccgggtcgacgatttcgtgaagtagctcttatggctggagattgcaggtttatgactgatcctatttgggaagaacaatgatggcaggcattcgagctttatttatgtacttgtggctgcagctggactgggtgagcagaggagagagtgtggggctgcatcttcctaccctgagtgtccaggagggtgacaactctattatcaactgtgcttattcaaacagcgcctcagactacttcatttggtacaagcaagaatctggaaaaggtcctcaattcattatagacattcgttcaaatatggacaaaaggcaaggccaaagagtcaccgttttattgaataagacagtgaagcatctctctctgcaaattgcagctactcaacctggagactcagctgtctacttttgtgcagagatccctgaacagagatgacaagatcatctttggaaaagggacacgacttcatattctccccagcctgagtcaaggttattgcaatagcactaaagactgtgtaacaccaatgcaggcaaatcaacctttggggatgggactacgctcactgtgaagccaaatatccagaagcctgaccctgccgtgt

SEQ ID NO: 313 - DNA, 801 bp, Homo sapiens
  CDS (88)..(765)
cgaccacgcgtccgctcacgcggtcggcgaccacaatatgcgcgctctctttttgctgctccctaactctcggatacagacgataccatgggttttggacacctgaaaagccctgccggcctccatgagcttagcgattacctgggggactggagctacaaacagggggatgagccatcacatgctgatgaggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgaggaagacactacaagaagtggagctacagatagtaaggatgatgatgacattgacctctttggatctgatgatgaggaggaaagtgaggaagcaaagaagctacgagaagaacgccttgcacagtatgagtccaagaaagctaaaaagcctgcagttgttgcgaagtcttccatcctactagacgtgaagccttgggatgatgagacggacatgacaaaactagaggagtgtgtccgaagcattcaagcagatggcctggtgtggggctcctctaaattggttccagtgggatatggaattaaaaagcttcaaatacagtgtgtagttgaagatgataaggttggaacggatatgctggaagagcaaattactgcttttgaggactacgtacagtccatggatgtggctgcttttaacaagatttaaatcattcttaagtcagtgcacttaaatgagagctca

SEQ ID NO: 314 - DNA, 2307 bp, Homo sapiens
  CDS (318)..(2180)
ggggaaaaggcatcaacagcaccagcaaataaagaacagatgctcaattagtgatggtgatggacaagattcctttatttttgaagcaaatgaagcttggaaagattttcatggttctcttcttcgattttatgaaaatggagaactctgtgatgtcacactcaagtcacagcaaactgtacaatggcagttgagtgggttttgaaaaacgtctgaattgtagtgtctacatctaccttctgccttctctctaccctttgaaaaaaaataaatggcatgtttgagaagagagctctattaaaagaggaatatcgcatatggcttcagattctatgaatagtaaacaagctgggaatcacattacaaaggggaaaaggcaacaacagcaccagcaaataaagaacagatcctcaattagtgatggtgatggagaagattcctttatttttgaagcaaatgaagcttggaaagattttcatggttctcttcttcgattttatgaaaatggagaactctgtgatgtcacactcaaggttggctcaaagctaatctcttgtcacaagctggtattggcttgtgttattccctactttagagccatgtttctttctgaaatggctgaagccaagcaaacgctgattgagattagagattttgatggtgatgcaatagaagacttggtaaagtttgtctattcttcacggctcactttgactgttgacaatgtccagcctctcttatatgcagcctgtattctgcaggttgaactggtggctagagcttgttgtgaatacatgaagttacattttcatccctccaattgcctggcagtaagagcctttgcagaaagtcacaatcgaatagacttaatggacatggcggatcagtatgcctgtgaccattttactgaagtagtggagggtgaagactttgtaagtgtatcaccgcagcacctccataagcttttgtcctccagtgatctaaatattgaaaatgaaaagcaggtctataatgctgccatcaagtggcttcttgccaatcctcagcatcattccaaatggttggatgaaacacttgcacaggttcgcctgccattgttgccggttgattttcttatgggtgttgtggcaaaagaacagattgtcaagcaaaatctaaaatgtagagatttactggatgaagcaagaaattaccaccttcacttgagtagcagagcagtacctgactttgaatactccattcggactaccccaaggaagcatactgctggtgtgctgttttgtgtaggtggtcgaggtggatctggtgacccctttcgcagtattgaatgctattctatcaacaaaaacagttggttctttggaccagaaatgaatagtcgaaggcgacatgtgggtgtaatctctgtggaaggtaaagtgtatgcagtaggtggacatgatggaaatgaacatttagggagtatggagatgtttgatcctctcactaataaatggatgatgaaggcatcaatgaacacaaagaggcgaggaattgccttggcttccttaggaggcccaatttatgcaattggagggttagatgacaatacttgcttcaatgatgtggagagatatgacatagaatctgatcagtggagtacagtggcaccaatgaatactccccgtggaggagttggctctgttgctctagtaaaccatgtttatgcagtaggtggcaatgatggaatggcttctttatctagcgtggagagatatgatccacatctggataagtggatagaagttaaagaaatgggtcagcgaagagcaggcaatggagttagcaagcttcatggttgcttatacgtagttggtggttttgatgataattctcctctgagttcagttgagcggtatgacccccgaagcaacaagtgggattatgtggcagcacttactactcccagaggtggagtgggaatcgcaacagtgatgggcaaaatctttgcagttggtggtcataatggcaatgcatacttaaatacagtagaagcgtttgatccagtgctgaataggtgggagcttgttggatctgtgtctcactgcagagctggagcaggagtagctgtgtgttcctgtttaactagccaaattcgagatgtaggtcatggatccaataatgtggttgactgtatgtgatttgagttctggccaccaacaatttagtcatatctgataggtacaaaagaaaaccaagattttgatatgaccacctttcaacactttttactgcaactagagtcttatttaaatgttaactgtgtat

SEQ ID NO: 315 - DNA, 1811 bp, Homo sapiens
  CDS (192)..(1652)
cggacgcgtgggctctccgtcagtgcggtttcgtctttatggtggtggagtccgcccaggctgtggaccgcaaataaccctgtacaaagaggaatggagattgcctctatccacctagattcataagctggcctgaggtgatcttggcatcaaggaagggatgcacatcatcacaccatcagcttcagagaatggcagccatttatttgtcccgtgggtttttttccagggaaccaatctgcccttttgaagaaaagacaaaggtagaaaggatggtggaggactacctggcaagtggttatcaggattcagtgacgtttgatgatgtggctgtggacttcaccccagaggagtgggctttactggacacaactgagaaatacctctacagagatgtgatgctggagaactacatgaacctggcctctgtggaatgggaaatacaacctagaaccaaacggtcatcacttcagcagggttttttgaagaatcaaatattcagtgggatacaaatgacaagagactacagtggatggaaactctgtgactgtaagaattgtggagaggtcttcagggaacagttttgccttaagacacacatgagagttcagaatggagggaatacttctgagggtaattgttatggaaaagacaccctcagtgtgcacaaggaagcctctactggacaggaactttccaaatttaatccatgtggaaaagtctttactctaactccaggtcttgctgtacatcttgaagttctcaatgcaagacaaccctacaaatgtaaggaatgtggaaaaggctttaagtattttgcaagccttgataatcatatgggaatccacactgatgagaaactctgtgaatttcaggaatatgggagagctgtcacagcttcttcacacctaaagcagtgtgtagcagttcatacaggaaagaaatccaaaaagactaagaaatgtgggaaatccttcactaatttttctcaactttatgcacctgtgaaaactcataaaggagagaagtcctttgaatgtaaagaatgtggaagatcctttagaaattcctcatgccttaatgatcacattcaaattcacactggaataaaaccacacaagtgtacttactgtgggaaagccttcactagatcaactcaacttactgaacatgtaagaactcacactggaataaaaccctatgaatgtaaggaatgtggccaagcctttgctcagtactcgggcctttctatacacatacgaagtcacagtggaaagaaaccctatcagtgtaaggaatgtgggaaagccttcactacatccacaagtcttattcagcatacaagaattcacacaggagagaagccttatgaatgtgttgaatgtgggaagaccttcattacttcttcccgtcgtagtaaacatttgaaaactcatagtggagaaaagccctttgtatgcaagatatgtgggaaagcatttctatattcctcacgccttaatgttcacctgcgaactcataccggagagaaacccttcgtatgtaaagaatgtgggaaagcatttgctgtttcctcacgcctaagtagacatgaaagaattcacactggggagaaaccctatgaatgcaaggatatgagtgttaccatttagcccatcggttgccatctttaattattggcaatgacaccaaagattatcagatttgtcctaaatgccttttggaggttgtaatgactcatggattggccttagataccatcctgagggtctgaaattaaacctacaggttctgaatacaaaaaaaaaaaa

SEQ ID NO: 316 - DNA, 4059 bp, Homo sapiens
  CDS (51)..(3131)
cccatgggctgtgttacatagagacagcagaacttgatggcgagaccaacatgaaagtacgtcaggcgattccagtcacctcagaattgggagacatcagtaagcttgccaagtttgacggtgaagtgatctgtgaacctcccaacaacaaactggacaaattcagcggaaccctctactggaaggaaaataagttccctctgagcaaccagaacatgctgctgcggggctgtgtgctgcgaaacaccgagtggtgcttcgggctggtcatctttgcaggtcccgacactaagctgatgcaaaacagcggcagaacaaagttcaaaagaacgagtatcgatcgcctaatgaataccctggtgctctggatttttggattcctggtttgcatgggggtgatcctggccattggcaatgccatctgggagcacgaggtggggatgcgtttccaggtctacctgccgtgggatgaggcagtggacagtgccttcttctctggcttcctctccttctggtcctacatcatcatcctcaacaccgttgtgcccatttcactctatgtcagtgtggaggtcatccgtctgggccacagctacttcatcaactgggataagaagatgttctgcatgaagaagcggacgcctgcagaagcccgcaccaccaccctaaacgaggagctgggccaggtggagtacatcttctccgacaagacgggcaccctcacccagaacatcatggttttcaacaagtgctccatcaatggccacagctatggtgatgtgtttgacgtcctgggacacaaagctgaattgggagagaggcctgaacctgttgacttctccttcaatcctctggctgacaagaagttcttattttgggaccccagcctgctggaggctgtcaagatcggggacccccacacgcatgagttcttccgcctcctttccctgtgtcatactgtcatgtcagaagaaaagaacgaaggagagctgtactacaaagctcagtccccagatgagggggccctggtcaccgcagccaggaactttggttttgttttccgctctcgcacccccaaaacaatcaccgtccatgagatgggcacagccatcacctaccagctgctggccatcctggacttcaacaacatccgcaagcggatgtcggtcatagtgcggaatccagaggggaagatccgactctactgcaaaggggctgacactatcctactggacagactgcaccactccactcaagagctgctcaacaccaccatggaccaccttaatgtgggtgagtacgcaggggaagggctgaggaccctggtgctggcctacaaggatctggatgaagagtactacgaggagtgggctgagcgacgcctccaggccagcctggcccaggacagccgggaggacaggctggctagcatctatgaggaggttgagaacaacatgatggaatccttgtggtattttcagctgctgggtgcaacggccattgaggacaaacttcagcaaggggttccagagaccattgccctcctgacactggccaacatcaagatttgggtgctaaccggagacaagcaagagacggctgtgaacatcggctattcctgcaagatgctgacggatgacatgactgaggttttcatagtcactggccatactgtcctggaggtgcgggaggagctcaggaaagcccgggagaagatgatggactcatcccgctctgtaggcaacggcttcacctatcaggacaagctttcttcttccaagctaacttctgtcctggaggccgttgctggggagtacgccctggtcataaatggtcacagcctggcccacgcactggaggcagacatggagctggagtttctggagacagcgtgtgcctgcaaagctgtcatctgctgccgggtgacccccttgcagaaggcacaggtggtagaactggtcaagaagtacaagaaggctgtgacgcttgccattggagacggagccaatgatgtcagcatgatcaaaacggctcacattggtgtggggatcagtgggcaggaagggatccaggctgtcttggcctccgattactccttctcccagttcaagttcctgcagcgcctcctgctggtgcatgggcgctggtcctacctgcgaatgtgcaagtttctttgctatttcttctacaaaaactttgctttcaccatggtccacttctggtttggcttcttctgtggcttctcagcccagaccgtctatgaccagtatttcatcaccctgtataacatcgtgtacacctccctgccagtcctggctatgggggtctttgatcaggatgtccccgagcagcggagcatggagtaccctaagctgtatgagccgggccagctgaaccttctcttcaacaagcgggagttcttcatctgcatcgcccagggcatctacacctccgtgctcatgttcttcattccctatggggggtttgctgatgccacccgggatgatggcactcagctggctgactaccagtcctttgcagtcactgtggccacatccttggtcattgtggttagcgtgcagattgggctcgacacaggctactggacggccatcaaccacttcttcatctggggaagccttgctgtttactttgccatcctctttgccatgcacagcaatgggctcttcgacatgtttcccaaccagttccggtttgtggggaatgcccagaacaccttggcccagcccacggtgtggctgaccattgtgctcaccacagtcgtctgcatcatgcccgtggttgccttccgattcctcaggctcaacctgaagccggatctctccgacacggtccgctacacacagctcgtgaggaagaagcagaaggcccagcaccgctgcatgcggcgggttggccgcactggctcccggcgctccggctatgccttctcccatcaggagggcttcggggagctcatcatgtctggcaagaacatgcggctgagctctctcgcgctctccagcttcaccacccgctccagctccagctggattgagagcctgcgcaggaagaagagtgacagtgccagtagccccagtggcggtgccgacaagcccctcaagggctgaaggccgaggatggatgccctgtgccagtgaccagagcacccagggctggccagtcactgagggaacagcgtctcggaactgctggtcctcattccttgcttcccgtccccccggtagactctgtcctgctggtcccaccacacatggctgggacatctgttcccagctgtaggcccttccaccagctggggagctagagggagcaggcccaagggcagagcagaggctgaggcacggggagccagccccactcggggaccagaagtggaaccaaaaacaagaaaaaactgtgagagattgtgtctgcccctgccctgcctgggacccacagggagactataatctccttatttttttactcctactccccagaggggccctagtgcctctgttcctgaattacataagaatgtaccatgccgggaagccagagacctgcaggggcctcggcccctcacatcgtgtatgtctctccttgatttgtgttgtgtccagtttggttttgtctttttttatttggcaagtggaggaggcttttatgtgacttttatgttgtggttggtgtcttaactctcctgggaaaaggaggctggcacacactgggatgccgcagcctggccggctgtggggtggtttgggaggatccatgtcggctctgcctgcagtgaccagtgctctgtggggcagaggagctgaccagggagggaggtacccatgagcagagggtagtgggagagtgtaaaggagggtttggtcctgtctgcttcctcaccttgagagtaaagtgctgccctctgcccccaacacacacacatatcaattcctggattccttagtcctgctggccttgggctggagcctaggaaagtggcccccaaatccttagtgagctaaagctgggtctgaaatttggtcagtggggaggggt

SEQ ID NO: 317 - DNA, 2976 bp, Homo sapiens
  CDS (18)..(2174)
tttcgtgcgggtacctgatggccacagatggctctaggaggccgagcgtccacaaagcagtggaaatcgagcaggagcgggtgaagtcagcgggggcctggatcatccacccctacagcgacttccggttttactgggacctgatcatgctgctgctgatggtggggaacctcatcgtcctgcctgtgggcatcaccttcttcaaggaggagaactccccgccttggatcgtcttcaacgtattgtctgatactttcttcctactggatctggtgctcaacttccgaacgggcatcgtggtggaggagggtgctgagatcctgctggcaccgcgggccatccgcacgcgctacctgcgcacctggttcctggttgacctcatctcttctatccctgtggattacaccttcctagtggtggagctggagccacggttggacgctgaggtctacaaaacggcacgggccctacgcatcgttcgcttcaccaagatcctaagcctgctgaggctgctccgcctctcccgcctcatccgctacatacaccagtgggaggagatctttcacatgacctatgacctggccagtgctgtggttcgcatcttcaacctcattgggatgatgctgctgctatgtcactgggatggctgtctgcagttcctggtgcccatgctgcaggacttccctcccgactgctgggtctccatcaaccacatggtgaaccactcgtggggccgccagtattcccatgccctgttcaaggccatgagccacatgctgtgcattggctatgggcagcaggcacctgtaggcatgcccgacgtctggctcaccatgctcagcatgatcgtaggtgccacatgctacgccatgttcatcggccatgccacggcactcatccagtccctggactcttcccggcgtcagtaccaggagaagtacaagcaggtggagcagtacatgtccttccacaagctgccagcagacacgcggcagcgcatccacgagtactatgagcaccgctaccagggcaagatgttcgatgaggaaagcatcctgggcgagctgagcgagccgcttcgcgaggagatcattaacttcacctgtcggggcctggtggcccacatgccgctgtttgcccatgccgaccccagcttcgtcactgcagttctcaccaagctgcgctttgaggtcttccagccgggggatctcgtggtgcgtgagggctccgtggggaggaagatgtacttcatccagcatgggctgctcagtgtgctggcccgcggcgcccgggacacacgcctcaccgatggatcctactttggggagatctgcctgctaactaggggccggcgcacagccagtgttcgggctgacacctactgccgcctttactcactcagcgtggaccatttcaatgctgtgcttgaggagttccccatgatgcgccgggcctttgagactgtggccatggatcggctgctccgcatcggcaagaagaattccatactgcagcggaagcgctccgagccaagtccaggcagcagtggtggcatcatggagcagcacttggtgcaacatgacagagacatggctcggggtgttcggggtcgggccccgagcacaggagctcagcttagtggaaagccagtactgtgggagccactggtacatgcgccccttcaggcagctgctgtgacctccaatgtggccattgccctgactcatcagcggggccctctgcccctctcccctgactctccagccaccctccttgctcgctctgcttggcgctcagcaggctctccagcttccccgctggtgcccgtccgagctggcccatgggcatccacctcccgcctgcccgccccacctgcccgaaccctgcacgccagcctatcccgggcagggcgctcccaggtctccctgctgggtccccctccaggaggaggtggacggcggctaggacctcggggccgcccactctcagcctcccaaccctctctgcctcagcgggcaacaggcgatggctctcctgggcgtaagggatcaggaagtgagcggctgcctccctcagggctcctggccaaacctccaaggacagcccagccccccaggccaccagtgcctgagccagccacaccccggggtctccagctttctgccaacatgtaaaacctttgagtacatccagccttagttcttggggtgcagtagtatgtacccaagggcagatgcctcttggggaaggccatggggacctgaaacattgccccatggaaatgtcgaccctgtgcggacattccgcatactgccatgaagacggtctctgtgtcctcagctcaagaatcctgtagcttgtcccatcataatccattcacccgttcatcatgtgtactgagcagctaccatgttcaaggtaatatgccaggcgctgtatgtctccactgccaagtagaagtgactcaaaaccctctgacaaggatattcccttggctatggtcctgccaggtgcaggcccaggcccatgaccccacctttactaagcacaagtacttgccactgccatcactgccaagtaactagatgtctctgtttccctgccaatgatcctgcaggttctgcccggtctggttatcttcctgttcctgtagcatagccaggcactgccaatcacctgtgcccccattgctgtcagcagatgtcttgggtcctgagtgtgggtatccacttttacccgctcactgccacctgtggacactctgtgtctaccctctgagtgggaacatacttctaagttccctgcagtctctgtcctgtggtagaccatctttttgtaaactgcgagcttcctcttccctgtaccctctgccccagtcgtgatcccctaaaagttaaggggtagctggcacctccttattaatatgacaacctagatcccccccggtggaggggcaaatggctgaatccttgtgtg

SEQ ID NO: 318 - DNA, 744 bp, Homo sapiens
  CDS (131)..(631)
cagatgcaattcggcacgagggtcgacttcggcgggagcccaggtgagaaaggcccacctgtgtcctggttgagggtctccagggttctttggggcccgaggccaatggtggcagagtctacatagaactatgcttcgtggtgttctggggaaaacctttcgacttgttggctatactattcaatatggctgtatagctcattgtgcttttgaatacgttggtggtgttgtcatgtgttctggaccatcaatggagcctacaattcaaaattcagatattgtctttgcagaaaatcttagtcgacatttttatggtatccaaagaggtgacattgtgattgcaaaaagcccaagtgatccaaaatcaaatatttgtaaaagagtaattggtttggaaggagacaaaatcctcaccactagtccatcagatttctttaaaagccatagttatgtgccaatgggtcatgtttggttagaaggtgacaatctacagaattctacagattccaggtgctatggacctattccatatggactaataagaggacgaatcttctttaagatttggcctctgagtgattttggatttttacgtgccagccctaatggccacagattttctgatgattagtaagcatttattcttttgacttgattattgtctccttttcatgtgaatttattactcccgttgaaaccgtgtacttaccaataaactatttgctattcaaaaaaaaaaaaaaa

SEQ ID NO: 319 - DNA, 2035 bp, Homo sapiens
  CDS (147)..(1355)
tttcgtgcacaactgagagtggcagaagctcagctgacaaggactggggacggcggtgtccttgtcttgcctttgtcgcccccgcccctctcttccctggctggacttgcggagtccccgccgaagaacccgagggtcccctggcgatggcagaaatgaaccctgcacagggtcatgtggtttttgaagacgtggccatatatttctcccaggaggagtgggggcatctcgatgaggctcagagattgctgtaccgtgatgtgatgctggagaatttggcccttttgtcctcactaggttgttgccatggagctgaggatgaggaggcacctttagagccaggtgtttctgtaggagtgtcacaggtcatggctccaaagccctgtctatctacccagaatacccagccctgtgagacatgtagctcacttctgaaggacattctgcgtctggctgagcatgacggaacacaccccgagcagggactgtacacgtgtccagcacatcttcaccagcaccaaaaggagcagattagagagaaactttctagaggggatggaggaagaccgacatttgtgaagaaccacagagttcacatggcagggaagaccttcttgtgcagtgaatgtgggaaagcctttagccacaaacataaactttctgaccatcagaaaatccacactggagaaagaacttataagtgcagcaaatgtgggatattgtttatggaaaggtccacactcaatagacatcagagaactcacactggagaaaggccttatgagtgcaatgaatgtgggaaagcctttctttgtaagtctcaccttgttcgtcaccagacaatccactctggagaaaggccttatgagtgcagtgaatgtgggaaattgtttatgtggagttccacactcattacacatcagagggttcacactggaaagaggccttatggttgcagtgaatgtgggaagttctttaagtgcaactcaaacctctttaggcattacagaattcatacaggaaaaaggtcttatggttgcagtgaatgtgggaaattctttatggaaaggtctacactcagtagacatcagagagttcacactggagaaaggccttatgagtgcaatgaatgtgggaaattcttcagcttgaaatccgtcctcattcaacaccaaagagttcacactggagaacggccttatgaatgcagtgagtgtgggaaggccttccttacaaagtcccacctcatttgtcatcagacagttcacactgcagcaaagcagtgcagtgaatgtgggaaattctttaggtataactctacacttctcagacatcagaaagtccacactggataaggcccttatgaatgcagtggatatgggaaagccttcagtcaccaacatattgtggctggacagcaggcagtacacactggagaaagactgaatgccgtgaacgtgggtaattatgtaggtacagctctccagtcgctatgtatcagagaattcacactgcagaaatgtgtgttcagcaaactcgggacattattttggtttgactctcatctcattagacattggagagtttacactgaagaagagtcttttcaataaagtagaaagtggtaaagattcaacatgcaagattgtacttattgggcttcagaatatccacactagtgaaagtcttctgagtacagcaaatgtgtgacattattttgctactactccacactacttagacatcatgtagttcacactggaaaaaggccacgtatgtgccttgaatgtagccaaaatgatgaacaacacccagaaatctgtgatttagcactgagaactagtattatatggtttttaaaaaacaatggtgaagtacatgccacataaaatttgccatcttaactattgtaatgtcttgtttaatacttgaagtacattaacattgttgagcaaagaatatcctgaactctttatcttgtaaaatgaaactctataaccaccattaaaaaaacaactcattcccaaaaaaaaaa

SEQ ID NO: 320 - DNA, 3695 bp, Homo sapiens
  CDS (6)..(2072)
cgtttatgctactttttctgaaacatttgatactaaaggatcgaggggtcaaggaagatgaacttcagagtatattaaattacctacttacgatgcatgaggatgaaaatattcatgatgtgctacagttactggtggctttaatgtcggaacacccagcctcaatgataccagcatttgatcaaagaaatggaataagggtgatctacaaattattggcttctaaaagtgaaagtatttgggttcaagctttgaacgttctgggatactttctgaagcatttaggtcacaagagaaaagttgaaattatgcacacccatagtcttttcactcttcttggagaaaggctgatgttgcatacaaacactgtgactgtcaccacatacaacacactttatgagatcttgacagaacaagtatgtactcaggtcgtacacaaaccacatccagagccagattctacagtgaaaattcagaatccaatgattcttaaagtggtggcaactttgttaaaaaactctacaccaagtgcagagctgatggaagttcgtcgtttatttttatctgatatgataaaacttttcagtaacagccgtgaaaatagaagatgcttattgcagtgttcagtgtggcaggattggatgttttctcttggctatatcaatcctaaaaattctgaggaacagaagattaccgaaatggtctacaatatcttccggattcttttgtatcatgcaataaaatatgaatggggaggctggagagtctgggtggataccctctcaatagcccattccaaggtcacttatgaagctcataaggaatacctagccaaaatgtatgaggaatatcaaagacaagaggaggaaaacattaaaaagggaaagaaagggaatgtgagcaccatctctggtctttcatcacagacaacaggagcaaaaggtggaatggaaattcgagagatagaagatctttcacaaagccagagcccagaaagtgagaccgattaccctgtcagcacagatactcgagacttactcatgtcaacaaaagtgtcagatgatattcttggaaattcagatagaccaggaagtggtgtacatgtggaagtacatgatcttttagtagatataaaagcagagaaagtggaagcaacagaagtaaagctcgatgatatggatttatcaccggagactttagtaggtggagagaatggtgcccttgtggaggttgaatctctgttggataatgtatatagtgctgctgttgagaaactccagaacaatgtacatggaagtgttggtatcattaaaaaaaatgaagaaaaggataatggtccattgataacattagcagatgagaaagaagaccttcccaatagtagtacatcatttctctttgataaaatacccaaacaggaggaaaaactacttcctgaactttctagcaatcacattattccaaatattcaggacacacaagtacatcttggtgttagtgatgatcttggattgcttgctcacatgaccggtagcgtagacttaacttgtacatccagtataatagaagaaaaagaattcaaaatccatacaacttcagatggaatgagcagtatttctgaaagagacttagcgtcatcaactaaggggctggagtatgctgaaatgactgctacaactctggaaactgagtcttctagtagcaaaattgtaccaaatattgatgcaggaagtataatttcagatactgaaaggtctgacgatggcaaagaatcaggaaaagaaatccgaaaaatccaaacaactactacgacacaagctgtgcagggtcggtctatcacccaacaagaccgagatctccgagttgatttaggatttcgaggaatgccaatgactgaggaacagcgacgccagtttagcccaggtccacggactacaatgtttcgtattcctgagtttaaatggtctccaatgcaccagcggcttctcactgatttactatttgcattagaaactgatgtacatgtttggaggagcccattctacaaagtctgtaatggattttgtcaatagcaatgaaaatattatttttgtacataacacaattcacctcatttcccaaatggtagacaacatcatcattgcttgtggaggaattttacctttgctctctgctgctacatcaccaactggttctaagacggaattggaaaatattgaagtgacacaaggcatgtcagctgagacagcagtaactttcctcagccggctgatggctatggttgatgtacttgtgtttgcaagctctctaaattttagtgagattgaagctgagaaaaacatgtcttctggaggtttaatgcgacagtgcctaagattagtttgttgtgttgctgtgagaaactgtttagaatgtcggcaaagacagagagacaggggaaataaatcttcccatggaagcagtaaacctcaggaagttcctcaaagtgtgactgctacagcagcttcgaagactccattggaaaatgttccaggtaacctttctcctattaaggatccggatagacttcttcaggatgttgatatcaatcgccttcgtgctgttgtctttcgggatgtggatgatagcaaacaagcacagttcttagctctggctgttgtttacttcatttcggttctgatggtttccaagtatcgtgacatattagaaccccagagagagactacaagaactggaagccaaccaggtagaaacatcaggcaagaaataaattcaccaacaagtacagaaacacctgctgcatttccagacaccataaaagaaaaagaaacaccaactcctggtgaagatattcaggtagaaagttcaattccccatacagattcaggaattggagaggagcaagtggctagcatcctgaatggggcagaattagaaacaagtacaggccctgatgccatgagtgaactcttatccactttgtcatccgaagtgaagaaatcacaagagagcttaactgaaaatcctagtgaaacgttgaagcctgcaacatccatatctagcattagtcaaaccaaaggcatcaatgtgaaggaaatactgaaaagtcttgtggctgctccagttgaaatagcagaatgtggccctgaacctatcccatacccagatccagcattgaagagagaaacacaagctattcttcctatgcagtttcattcctttgacaggagtgttgtggtgcctgtaaagaaaccacctccaggtagtttagctgtaaccactgtgggagccactactgctggaagtgggctgccaacaggcagtacctctaatatatttgctgctactggagctacaccaaaaagtatgattaatacaacaggtgccgtggattcagggtcctcctcctcttcctcctcttctagttttgtgaatggtgctactagcaaaaaccttccagctgtacaaactgttgctccaatgccagaagattcagctgaaaatatgagcatcactgcaaaacttgaaagagcgttagaaaaagttgctcctcttcttcgtgaaatttttgtagactttgccccattcctatctcgtacacttcttggcagtcatggacaagagctattgatagaaggccttgtttgtatgaagtccagcacatctgtggttgagcttgttatgctgctttgttc

SEQ ID NO: 321 - DNA, 1873 bp, Homo sapiens
  CDS (114)..(1148)
tttcgttggctggcagcagccttggactccgcccgtggagccctgggcctgttgacccaccagcttaggagcacccaccaagctctgggtcaacgtggaggtaccaggccaccatgctcagtctcaagctgccccaacttcttcaagtccaccaggtcccccgggtgttctgggaagatggcatcatgtctggctaccgccgccccaccagctcggctttggactgtgtcctcagctccttccagatgaccaacgagacggtcaacatctggactcacttcctgcccacctggtacttcctgtggcggctcctggcgctggcgggcggccccggcttccgtgcggagccgtaccactggccgctgctggtcttcctgctgcccgcctgcctctaccccttcgcgtcgtgctgcgcgcacaccttcagctccatgtcgccccgcatgcgccacatctgctacttcctcgactacggcgcgctcagcctctacagtctgggctgcgccttcccctatgccgcctactccatgccggcctcctggctgcacggccacctgcaccagttctttgtgcctgccgccgcactcaactccttcctgtgcaccggcccctcctgctactcccgtttcctggagctggaaagccctgggctcagtaaggtcctccgcacaggagccttcgcctatccattcctgttcgacaacctcccactcttttatcggctcgggctgtgctggggcaggggccacggctgtgggcaggaggccctgagcaccagccatggctaccatctcttctgcgcgctgctcactggcttcctcttcgcctcccacctgcctgaaaggctggcaccaggacgctttgattacatcggccacagccaccagttattccacatctgtgcagtgctgggcacccacttccagctggaggcagtgctggctgatatgggatcacgcagagcctggctggccacacaggaacctgccctgggcctggcaggcacagtggccacactggtcttggctgcagctgggaacctactcattattgctgctttcacagccaccctgcttcgggcccccagtacatgccctctgctgcagggtggcccactggaggggggtacccaggccaaacaacagtaaggccccatccctgaccctgtcctggagggggcagaggccaggccccagtgctgacgaggagcccagatttgggcctaatcaggtggggacgcatctcagcctggaaccaacaggggctgaggagagagggcacaggagagagggcagagaagaggaggggtgtctagggggactggcagagtgtgagagggaccgtgagggggctcttgatgggagtggaagaagtgctgagggtctgagaggggagatgcatgcgtgtccaggctgaagatgcccctatattctgtcaaaggttggcggggggaggtgttggggtcctttcatctggctccgtttctggtgcttctggaagtctctgctcagcacagggaagaactaacacgactaacctaggcctaccctgaatgcttcttgctaaccaggccgagaggccacacacttgcccccccatccccacaaaccaggtaatgccagtttgccagcagctatttgcctatagagatgagtctgtcctggtcataactgtgtgctcaaggtgtccaggcttttgggggtgggcctatctgggtgcattatggatggtttggtggattgaggtgtggggaggagggtcctaggctagagggggtatccctagttagactttgggaagccaccttcaatgttttctggaacaaggcaggtacaaataaaaaaataaaactttggaaagcaaaaaaaaaaaa

SEQ ID NO: 322 - DNA, 1552 bp, Homo sapiens
  CDS (316)..(630)
gggagcccgcgccccgcccgccgcgcctctgccgggacccacccgcagcggagggctgagcccgccggcggctccccggagctcacccacctccgcgcgccggagcgcaggcaaaaggggaggaaaggctcctctctttagtcaccactctcgccctctccaagaatttgtttaacaaagcgctgaggaaagagaacgtcttcttgaattctttagtaggggcggagtctgctgctgccctgcgctgccacctcggctacactgccctccgcgacgacccctgaccagccggggtcacgtccgggagacgggatcatgaagcgctcggtagccgtctggctcttggtcgggctcagcctcggtgtcccccagttcggcaaaggtgatatttgtgatcccaatccatgtgaaaatggaggtatctgtttgccaggattggctgatggttccttttcctgtgagtgtccagatggcttcacagaccccaactgttctagtgttgtggaggttgcatcagatgaagaagaaccaacttcagcaggtccctgcactcctctactcaccgagctctttttggactccaaaaatggtatccctactatgcacgtcttaataagaaggggcttataaatgcgtggacagctgcagaaaatgacagatggccgtggattcagataaatttgcaaaggaaaatgagagttactggtgtgattacccaaggagccaagaggattggaagcccagagtatataaaatcctacaaaattgcctacagtaatgatggaaagacttgggcaatgtacaaagtgaaaggcaccaatgaagacatggtgtttcgtggaaacattgataacaacactccatatgctaactctttcacaccccccataaaagctcagtatgtaagactctatccccaagtttgtcgaagacattgcactttgcgaatggaacttcttggctgtgaactgtcgggttgttctgagcctctgggtatgaaatcaggacatatacaagactatcagatcactgcctccagcatcttcagaacgctcaacatggacatgttcacttgggaaccaaggaaagctcggctggacaagcaaggcaaagtgaatgcctggacctctggccacaatgaccagtcacaatggttacaggtggatcttcttgttccaaccaaagtgactggcatcattacacaaggagctaaagattttggtcatgtacagtttgttggctcctacaaactggcttacagcaatgatggagaacactggactgtataccaggatgaaaagcaaagaaaagataaggttttccagggaaattttgacaatgacactcacagaaaaaatgtcatcgaccctcccatctatgcacgacacataagaatccttccttggtcctggtacgggaggatcacattgcggtcagagctgctgggctgcacagaggaggaatgaggggaggctacatttcacaaccctcttccctatttccctaaaagtatctccatggaatgaactgtgcaaaatctgtaggaaactga

SEQ ID NO: 323 - DNA, 1867 bp, Homo sapiens
  CDS (300)..(1430)
aaaataattaagtcttggatctcatctaataaccattttttttttatcccttgcatactgcagcttacttttttgttacagggtttgcatttaaacggaaacatcatcgtccaggaacaaatgtggtcttttcatattatttgggagaacagcaggacttcagtgagttggtagcagtacaatagctcactcgggctactgcagtctagctgtagacatgttaattaatatatttctctgacacctaggtgattgaaatagcaattaaagagtaattaaaatgtttacttcttgtaggaatgtcaactaagatgtggaatatagcaattacctatgacggattagaggaagatgatgaggtctttgaagtaattctgaactcccctgtgaatgcagttcttggcacaaagacaaaagctgcagtgaaaattttggactcaaaaggaggacaatgccatccttcatattcctccaaccaaagcaagcacagcacatgggagaagggcatttggcatctgctgcccccagggtcttcctcatccaccacttctggttcctttcatctggaaagaagacctcttccatcttccatgcagctagcagtcatcaggggagacaccctgcggggctttgattctacagatctttctcaaaggaagcttaggacccgtgggaatggcaaaacagttcgtccatcctctgtttatagaaatggaacagacatcatctataattatcatgggatagtttccttgaaactggaggatgacagtttcccaactcacaaaaggaaggccaaagtatccatcattagtcagccacaaaagacaatcaaagtggcagaactgcctcaagcagataaggtggaatccacaactgactcacacttccccagacaggaccagttgccctcatttccaaagaactgcactctggaattaaagggactcttccattttgaagaaggcatccagaagctgtatcagtgcaatgggatcgcctggaaagcctggagtccccaaaccaaggatgtggaagacaaatcctgtccagccgggtggcaccagcactcaggctactgtcacatcttgatcacagagcagaaaggcacctggaatgcggctgcccaagcttgcagggaacaatacctgggcaaccttgtaactgtattctccaggcagcacatgcggtggctctgggacattggtgggagaaagtccttttggataggtttgaacgaccaagtgcatgctggccactgggagtggatcggtggtgaacctgttgccttcaccaatgggagaagagggccctctccacgctccaagcttggaaagagctgtgttttggttcaaagacaagggaaatggcaaacaaaagactgtaggagagccaaacctcataattatgtgtgttccagaaaactctaaatataacagaccctacagggggccacctggagtttgtcacctatttattcacaggatctgtgaatattgctccatagaaaacaaattgttatgattgagtgggtatacctttgtgattctgtctagtgaaaatgggacatttttaatagtgccagaaagattgataaataaatattttttacaagataagatacaatttttgtatctcaataccttttaaaataaatgccagcagtattaaaaagtgtaaggtttgtttattccagaagaccctcacccttaccccattccaaatctcagggagcaccagtctcatagtccttggattttttttaaaaaaaatttttggtcccgttacctctaatgaatttattctgaaatatgtatcgtaggtgctcctaccactttagtccgagtggaaagctaaaaaacccctt

SEQ ID NO: 324 - DNA, 3639 bp, Homo sapiens
  CDS (371)..(1903)
tttcgttgaacgagcatgaagatttgaaattgctccgattggaaggaagcccaggttaggtttgggcacctccaaacgcacccgttttaaagccacctggactgaggcgtcgagctttcagctccaccaaacgctcacctggcctggcagcgagcggcggaagagcccgggagcccctcacagagcgcaccgagccgggcggagagctgagccgcaggcacccgcgtctccaggatgataggcgacattgcaacaaatctctacacccagcagctcagggggctccaagcagagcagcaagttcgaggatccgggcgtggagccgagtgaggccgcagcccagcgggcctcgggcgaaaaatcttggaaaatgtataccagtcatgaagatattgggtatgattttgaagatggccccaaagacaaaaagacactgaagccccacccaaacattgatggcggatgggcttggatgatggtgctctcctctttctttgtgcacatcctcatcatgggctcccagatggccctgggtgtcctcaacgtggaatggctggaagaattccaccagagccgcggcctgaccgcctgggtcagctccctcagcatgggcatcaccttgatagtgggccctttcatcggcttgttcattaacacctgtgggtgccgccagactgcgatcattggagggctcgtcaactccctgggctgggtgttgagtgcctatgctgcaaacgtgcattatctcttcattacttttggagtcgcagctggcctgggcagcgggatggcctacctgccagcggtggtcatggtgggcaggtatttccagaagagacgcgccctcgcccagggcctcagcaccacggggaccggattcggtacgttcctaatgactgtgctgctgaagtacctgtgcgcacagtacggctggaggaatgccatgttgatccaaggtgccgtttccctaaacctgcgtgtttgtggggcgctcatgaggcccctctctcctggtaaaaacccaaacgacccaggagagaaagatgtgcgtggcctgccagcgcactccacagaatctgtgaagtcaactggacagcagggaagaacagaagagaaggatggtgggctcgggaacgaggagaccctctgcgacctgcaagcccaggagtgccccgatcaggccgggcacaggaagaacatgtgtgccctccggattctgaagactgtcagctggctcaccatgagagtcaggaagggcttcgaggactggtattcgggctactttgggacagcctctctatttacaaatcgaatgtttgtagcctttattttctgggctttgtttgcatacagcagctttgtcatccccttcattcacctcccagaaatcgtcaatttgtataacttatcggagcaaaacgacgttttccctctgacgtcaattatagcaatagttcacatctttggaaaagtgatcctgggcgtcatagccgacttgccttgcattagtgtttggaatgtcttcctgttggccaacttcacccttgtcctcagtatttttattctgccgttgatgcacacgtacgctggcctggcggtcatctgtgcgctgatagggttttccagtggttatttctccctaatgcccgtagtgactgaagacttggttggcattgaacacctggccaatgcctacggcatcatcatctgtgctaatggcatctctgcattgctgggaccaccttttgcagggtggatctatgacatcacgcaaaaatatgatttttccttctacatatgtggtttgctttacatgataggaatactctttttacttattcagccgtgcattcgaattatagaacaatccagaagaaaatacatggatggtgcacatgtttagtatcatgtaatgttccgtgtaggtttcattgtaatactcatgcctacctcgcatggttgctgtgaggcacctatgacaggacgtgggaaagcattttgtacggtaactggcactgtcatttgtaaatgccattgtcacagcctcatttgtaagcagcactgcctctctgtttggggagatgtaatgctggaagatcttaaggactacatacattctagagatgacagtgttgttcaaagacagcctagtaagtaattggtagaaatgcccttataaaaaccattctcttgtcatctactgggactagggttttaaatacagcttttaaaaacaaaaacagggaataaaagcttttcaactcaaccacttctttgtaagacaaaactgaagtatctgtgtgcttccagaaagcttacagataaatgggtttcaagcacaagaatatgaccagatttcagaaattaattattacagggagctattgatctactagcatcaaacaaaggcaagctctaattccacaggtaatacaatttagtgcaattaaagaaacacggcttgtatttttatgagggaattctgcagctagggattgtgactcctaaatcctcctctaaaagaaggcacttgccattaatcctaattcagtgctatccagttataaatggaatcttgagacaaaaccttaacaaagaaataacagtaatgatttccttagcagaagccgtatttgtacgcacaacattaaatcaagggctacaattcaagcacttttattcgtatcattggcctcttagatgatataagcatgaggtggggcctgtaatatttttttctgagtttcttctgcccaaaaatataatatagaactaattgctaactgacaaataaagttaatagttaaatcatctccaaggaatgttgctaatccaaagtataacactatcaatttgtgaggataataaatggaatgccattagtgtagatgtctgtgccacatctgacactggagtagtgataacaaatagcccatctctagactctcgtgttgttatatagaccattcatttgcctgagcgtggcacagttttaaaaatagttctcttgattgatttcatacagaagatgactgtgatccatgacatctaataatgccctttctttatctgagatgtctatttttctaagccaaacgtttttcagactgcagaatgttcttcccagatcatttgaaatttctggctgccttacttgtttacagatagtttaagactatttaaatttctactcacaatttgatcatcacacacacacaaatccttgaatatcattgccagtgtcttaggtcaaatttacctaaagtgaatacagcccattctcaattatccttcacaattagacgcaggaatgctactaggaattggaatcaaacaatgccaccccaagcgtaattttagccagcagtttcagttatactcaaccatgcccttctgagctgttaacaagtgattcaatggacaagttctctttttgttccatctccattatttcctgctctaatgtatagtgggagtggttgtgtaatgaaaggaccaccaaaataataaaaggcagctaatggaaaggagagacaaaagcatggttaatatatatacttaatattacctccaatgactcgggaattgcctgtaaattattatagacaatagattgcatgtcatactccatttggctca

SEQ ID NO: 325 - DNA, 2270 bp, Homo sapiens
  CDS (263)..(2236)
agtatattgctaagaatggtttccagtcattgattcctgggtgtcttgcttgattttcataatagcacggttaatgttctatagtcaagttttatattacaattacttgcaactagttgtgaagtctgaaatattcgattcaattgcaaactttgagtgtagtttttgaaaagatgttatttagactgtatatttttttcttcttttttgagttagtgccaattataacattttaatcaaactggaacaaattgctattaaaatggatcatttctttattaaaagaaagaggaatagtgaagtgaaatatacagaagcatgttcaagttcatctgttgaatccggaattgtgaatagtgacaatattgagaaaaatactgactccaatctgcaaacttcaacttcatttgagccacatttcaaaaagaaaaaagtaagtgcaagacgttataatgaagattacttaaaatatggctttatcaaatgtgaaaaaccctttgaaaatgacagacctcagtgtgttatttgtaataatattcttgcgaatgaaagcttaaaaccttcgaaattaaaaaggcacttagaaactcagcatgctgaacttattgataagcctcttgaatattttcaaagaaagaaaaaagacataaagttatcaacacaatttcttagttgttctactgctgttagtgagaaagccttattatcatcatatttagttgcatatcgtgtggcaaaagagaaaatagctaacacagctgctgaaaaaattattcttccagcatgtttggatatggtgcgtacaatatttgatgataaatcagctgataaattaaaaactatacctaatgataacacagtatctcttcgaatttgtactattgcagaacatttagaaacaatgcttattactcgtttacagtctggtatagattttgcaatccagcttgatgaaagcactgatattggaagctgcacaacacttttagtttatgtcagatatgcgtggcaagatgattttttggaggattttttgtgttttttaaatttaacctcacacctaagtggattagatatttttacagaattagaaaggcgcatagttggccaatataaattaaactggaaaaactgtaaaggaattacaagtgatggcacagcaaccatgactggaaaacatagcagagtaattaaaaaattactagaagttactaataatggtgctgtgtggaatcattgttttatacatcgtgaaggtttagcatccagagaaattccacagaatctcatggaggtattgaaaaatgcagtgaaagttgttaattttattaaaggaagctcattgaatagccggcttcttgaaacattttgttcagagattggaactaatcatacccacttactatatcataccaaaattcgttggttgtctcaagggaaaatactaagcagggtttatgagctcaggaatgagattcacttttttctcattgaaaaaaaatctcatttggcaagtatttttgaagatgatacttgggtaacaaaattggcatatttaactgatatttttagcattcttaatgaactgagtttaaaactacaggggaaaaacagtgatgtattccaacatgttgaacgtatccagggatttcgaaagacattattgttatggcaagtaagacttaaaagtaatcgtcctagctattacatgtttccaagatttttgcagcatattgaagagaatattattaatgaaaacattttgaaagaaataaaattagagatattgttgcatctcacttctctgtctcaaacttttaaccatttctttccagaagaaaaatttgaaacattaagggaaaacagttgggtaaaagatccatttgcttttcgaaaccctgaatcaataattgagctaaacttggtgcctgaagaagagaatgaattattgcagcttagttcttcatatacattgaagaatgattatgaaaccttaagtttatcagcattttggatgaaggtaaaggaagactttccattgttaagtagaaagagtgtcctgctattgctaccattcacaacaactagtttgtgtgaactagggttttccatcttaacgcagttaaaaacaaaggaaagaaatgggctgaattgtgcagcagttatgcgggtagcattatcttcctgtgttccagactggaatgaacttatgaacaggcaagcacacccatcatagtaaataaaaatcttacctagctttaaaaaaaaaa

SEQ ID NO: 326 - DNA, 3157 bp, Homo sapiens
  CDS (123)..(3068)
cgacccacgcgtgcgatcggctgcagggacgcgcgcaaggtgaacacgggggcttttgcgcgcaggctcatccagtgaggactggaaggtgggggctttaggcccaggcatcggagtagaccatggcctccagcccatggggctgtgtatgtggccttctgctgttgctgctgccactcctggggactggccctgccctggggaggggctttcccaggccacttgaaaactccgaaatccctatgatccctggagcccaccccaagggctctgtgggctcagagccccaggcctttgacgtgttcccggagaaccccagagctgacagtcacaggaactctgatgtccgccacgcccctgctgaagagatgcctgagaagcctgtagcctctccccttggcccagccctgtacgggcccaaagcagcacaaggagctcagagagaacgactcccagtaactgatgacctccagatggctcaaggaccaagctcccacggctggacaggacctctggactcacaagagcttctggagcaagaagcagtggctccccacccagtgggccaccctcatctcactttcatccccacaactcccagacgtcaactcagggtagccacagttcctccctccctgcagcatgaaggccaagagggacagtggccacctagagatgagggtctgaaggccaaaactaagagcagggtcccacccacttctccctcagaccaccagggcccaccccacacccttgtttcccactcaggtactgtcaagaggccagtgctggaaggacagggtgggtttgaggaacacttgcaggaggcagctcaaggtccccacttcacccagcaggatccagcagcccctgatgttggctcagtacccccagttgaggtggtgtactctcaggagccaggggcccagccagacttggcattggccagaagccttcctcctgctgaggagctgccggttgagacccccaagagggctggcgctgaggtgtcctgggaagtcagctccccaggtcccccgcccaagcaggctgaccttcctgacgctaaggattcaccaggaccccagcccacggatccacccgcctcagaggctcctgatcggccgtctaagccagagagagcagcaatgaatggagcagaccccatctccccccagcgggtgagaggagctgtggaggccccaggcacccccaagtctctcatccctggtccctcagaccctggcccagctgtaaaccgaacagagagccccatgggggccctgcagccagatgaagccgaggagtggccggggcgcccccaaagccatcccccagcacccccagtccaggccccctcgacgtcacgccggggcctcattcgagtcaccacgcagcgagccctgggccagcctccccctccggagcccaccgccagctccatggcttcagccccagcctccagccccccagccaacgccactgcacccccgctacgctggggcccccttcggcgggtcctgagcttctcctgggagctgcacgtctacggggtgggggtactctttctgctgcccgcgttgttggcgctggctgcgctggcagccgccccagcagggccccggctggcattggtggccgcggtgctggtgctcgtggcttcggcgctgcgatccgcctacatgcttaccgacccttacggctcgcaggcgcggctgggcgttcgcgggggcctggtgctctacaacctgcccttccccttgctgcttacggcgctggcagccctgactctgctcggcctgggcgcggggctgccgccaccgctgcaaaacccactcctgctgggagcagtggcgctggtgcatggtgtagggttgctcgcgacagacctgctgtccacatggtctgtgctcaacctcctgacgcagggcttgtcgtgcgcctggggcgcggccgtggctctgggcacgctctgcctgtgccgtcgccgcctgctggacggcccacggggctgggatgccagcccgggccctcggctgttggctgtggcgggcgcgctggggctgctggctagcggcttgcagctggcggctgcgctctggctgtacccgggcccaggccgcgtgggccgcttctcgtgggcctggtggggtgtccacttctggctgcgcctcctggagctgacatgggcgctcgccctggcgttggccgcggtggctgccgcgagacccaggccgcccacggagcacgcttgctgggctaagctgatgcgtctggcgtgcccggcgccgtcaggaaagagcgaggtgccggagcgacccaataactgctatgcagggcccagcaacgttggtgcaggcagcttggacatcagcaagagcctcatccgcaacccggcggagagtgggcagctggccacgcccagttcaggcgcctggggctcggctgcgtcgttgggtcgcggaccccagggtggcccgggactgtcccgcaacggtgtgggaccggcgccatcgctgagcgagctggatctgcggccgccatcgcccatcaacctgagccgcagcatcgacgccgcgctcttccgcgagcacctagtgcgagacagtgtgttccagcgctgcggcctccgcggcctggcctccccgccgcctggaggcgctctgcggccgcgccggggcagccatcccaaagccgagctcgacgacgctggctcctcgctcctccgcggccgctgcaggtcgctcagcgacgtgcgcgtgcgcgggccggtcccacagcacgtagtggaagcacccgacggggcagccgctgcggcttctggcagctccctcgacagcttctccaggggttcactcaagatcagttggaacccctggcgccacgggctgtcatcagtggacagtctgcccctagatgagttgcccagcacggtacagctactgcctgccccgaccccagcccctgattctaccgccgctcggcagggggacggccagggagaggtccagccgcgcggcaagcctggggaatcccgcagcgcctccagtgataccatcgagctttgaagagcggtcctgacgcagggccaggaccctgcccgatgcccacatggcatggcctactgggacagttgagcctttaaaaaatgggcatc

SEQ ID NO: 327 - DNA, 2580 bp, Homo sapiens
  CDS (681)..(2303)
gagagcctgacggggcggtacgccgttgtgggtggcgatcggcatggagcaccgcccacggcgcaggttagcggggggaagtgcaggagctagctaagatagagtagggggtgctccagttaggcagccgtgtaggaggcgagttcgcgtaccgtgcacggcggcgccggcgatgtggagttcgctccaagccacctgcccgcttcatgtggaagcggggttccgataccctatcccacagccaggacaatggggttgacatctatgagcccctctacactcagggggagaccaaggtcctgaagctgaagaacctgcggccccaggactatgccagctacacctgccaggtgtctgtgcgtaacgtgtgcggcatcccagacaaggggaggaccttccggctcaccaacaccacggccatgaagaacgctacattccagatcactcctgacgtgatcaaagagagtgagaacatccagctgggccaggacctgaagctatcgtgccacgtggatgcagtgccccaggagaaggtgacctaccagtggttcaagaatggcaagccggcacgcatgtccaagcggctgctggtgacccgcaatgatcctgagctgcccgcagtcaccagcagcctagagctcattgacctgcacttcagtgactatggcacctacctgtgcatggcttctttcccaggggcacccgtgcccgacctcagcgtcgaggtcaacatctcctctgagacagtgccgcccaccatcagtgtgcccaagggtagggccgtggtgaccgtgcgcgagggatcgcctgccgagctgcaatgcgaggtgcggggcaagccgcggccgccagtgctctggtcccgcgtggacaaggaggctgcactgctgccctcggggctgcccctggaggagactccggacgggaagctgcggctggagcgagtgagccgagacatgagcgggacctaccgctgccagacggcccgctataatggcttcaacgtgcgcccccgtgaggcccaggtgcagctgaacgtgcagttcccgccggaggtggagcccagttcccaggacgtgcgccaggcgctgggccggcccgtgctcctgcgctgctcgctgctgcgaggcagcccccagcgcatcgcctcggctgtgtggcgtttcaaagggcagctgctgccgccgccgcctgttgttcccgccgccgccgaggcgccggatcacgcggagctgcgcctcgacgccgtaactcgcgacagcagcggcagctacgagtgcagcgtctccaacgatgtgggctcggctgcctgcctcttccaggtctccgccaaagcctacagcccggagttttacttcgacacccccaaccccacccgcagccacaagctgtccaagaactactcctacgtgctgcagtggactcagagggagcccgacgctgtcgaccctgtgctcaactacagactcagcatccgccagttgaaccagcacaatgcggtggtcaaggccatcccggtccggcgtgtggagaaggggcagctgctggagtacatcctgaccgatctccgtgtgccccacagctatgaggtccgcctcacaccctataccaccttcggggctggtgacatggcctcccgcatcatccactacacagagcccatcaactctccgaacctttcagacaacacctgccactttgaggatgagaagatctgtggctatacccaggacctgacagacaactttgactggacgcggcagaatgccctcacccagaaccccaaacgctcccccaacactggtccccccaccgacataagtggcacccctgagggctactacatgttcatcgagacatcgaggcctcgggagctgggggaccgtgcaaggttagtgagtcccctctacaatgccagcgccaagttctactgtgtctccttcttctaccacatgtacgggaaacacatcggctccctcaacctcctggtgcggtcccggaacaaaggggctctggacacgcacgcctggtctctcagtggcaataagggcaatgtgtggcagcaggcccatgtgcccatcagccccagtgggcccttccagattatttttgagggggttcgaggcccgggctacctgggggatattgccatagatgacgtcacactgaagaagggggagtgtccccggaagcagacggatcccaataaagtggtggtgatgccgggcagtggagccccctgccagtccagcccacagctgtgggggcccatggccatcttcctcttggcgttgcagagatgatgagagctgtgtggccacccccccaaccttgcccccggcacaccaaagtgtccacattgtaccaaagactgacccccgccagctggggtgcccaggggcagggccggcccgccagggagggggcctgcattggctgcaaggatgagcagagaacaaggacagaggccaggcactgaggccctggagacagctgttccacttgcacacacgcacacactcatgctcacacacacagagatatattaaagcacaagtttctatctgaaaaaaaaaaaaa

SEQ ID NO: 328 - DNA, 1111 bp, Homo sapiens
  CDS (46)..(894)
attggtgatgaaattttagagatcaatggtgagaccaccaaaaacatgaagcattctcgagctatagaactgattaagaatggtggccgcagagttcgtctgtttctgaagcggggagacggctcagtaccagaatatgaccccagcagcgaccgccacggccccgccaccggtccacaaggtgttccggaagtgagggccgggcccgaccgccggcagcatccgtcattggagtccagttacccacccgatcttcacaaatcatcaccacatggggaaaagcgggcacacgcaagggatccgaaaggcagcagagagtatagcagacaacccaatgaacaccacacctggaatgggacttcgaggaaacccgacagcggggcatgccgacccaaggaccgggcgccggagggacggagggacgcgcaggccgagcgcgcggcagccgccaacggccccaagaggcggtccccagagaagcggagggagggcacccgcagcgccgacaacactttggagaggagggagaagcacgagaagagacgagacgtctctccggagcggaggcgagagcggtcacccacccgcaggagagacggctcccccagccggcggagacggtctctggagagactcctggagcagaggaggtcccccgagcgcaggagagggggctcgcccgagcgcagggccaagtccaccgaccggaggcgcgcacgctcccccgagcgcaggagagagcggtccctggacaaaaggaacagagaggacagagccagccaccgagaaagggaagaggcgaatctgaaacaggatgccggcagaagttccagacatcccccggagcagagaaggcgaccttacaaagaatgtagcaccgacctcagtatctgagacgctgagtcacattccaacctttaccgtgtcaaaggttctaagaggaaagtcacaaacctgaaattatttagtttcttacctaatgaagcatctgacacctgatgatcctatgaataacaacaaacattttatgcatttgaaatcttataagaaaaaatatatatgaaaagtattgtgcctgatgtatcatattaaagaaagtatttttaaatgc

SEQ ID NO: 329 - DNA, 3104 bp, Homo sapiens
  CDS (89)..(2149)
agtctaagagaccagcgaattttagcagccagtcccagcgggctggcaacttgcaccccttcctaggcatcctccctgattcgcgaccatgctgttaaggggcgtcctcctggcgttgcaagccctgcagctcgccggtgccctcgacctgcccgctgggtcctgtgcctttgaagagagcacttgcggctttgactccgtgttggcctctctgccgtggattttaaatgaggaaggccattacatttatgtggatacctcctttggcaagcagggggagaaagctgtgctgctaagtcctgacttacaggctgaggaatggagctgcctccgtttggtctaccagataaccacatcttcggagtctctgtcagatcccagccagctgaacctctacatgagatttgaagatgaaagctttgatcgcttgctttggtcagctaaggaaccttcagacagctggctcatagccagcttggatttgcaaaacagttccaagaaattcaagattttaatagaaggtgtactaggacagggaaacacagccagcatcgcactatttgaaatcaagatgacaaccggctactgtattgaatgtgactttgaagaaaatcatctctgtggctttgtgaaccgctggaatcccaatgtgaactggtttgttggaggaggaagtattcggaatgtccactccattctcccacaggatcacaccttcaagagtgaactgggccactacatgtacgtggactcagtttatgtgaagcacttccaggaggtggcacagctcatctccccgttgaccacggcccccatggctggctgcctgtcattttattaccagatccagcaggggaatgacaatgtcttttccctttacactcgggatgtggctggcctttacgaggaaatctggaaagcagacaggccagggaatgctgcctggaaccttgcggaggtcgagttcaatgctccttaccccatggaggttatttttgaagttgctttcaatggtcccaagggaggttatgttgccctggatgatatttcattctctcctgttcactgccagaatcagacagaacttctgttcagtgccgtggaagccagctgcaattttgagcaagatctctgcaacttttaccaagataaagaaggtccaggttggacccgagtgaaagtaaaaccaaacatgtatcgggctggagaccacactacaggcttagggtattacctgctagccaacacaaagttcacatctcagcctggctacattggaaggctctatgggccctccctaccaggaaacttgcagtattgtctgcgttttcattatgccatctatggatttttaaaaatgagtgacaccctagcagtttacatctttgaagagaaccatgtggttcaagagaagatctggtctgtgttggagtccccaaggggtgtttggatgcaagctgaaatcacctttaagaagcccatgcctaccaaggtggttttcatgagcctatgcaaaagtttctgggactgtgggcttgtagccctggatgacattacaatacaattgggaagctgctcatcttcagagaaacttccacctccacctggagagtgtactttcgagcaagatgaatgtacatttactcaggagaaaagaaaccggagcagctggcacaggaggaggggagaaactcccacttcctacacaggaccaaagggagatcacactactggggtaggctactacatgtacattgaggcctcccatatggtgtatggacaaaaagcacgcctcttgtccaggcctctgcgaggagtctctggaaaacactgcttgacctttttctaccacatgtatggagggggcactggcctgctgagtgtttatctgaaaaaggaagaagacagtgaagagtccctcttatggaggagaagaggtgaacagagcatttcctggctacgagcactgattgaatacagctgtgagaggcaacaccagataatttttgaagccattcgaggagtatcaataagaagtgatattgccattgatgatgttaaatttcaggcaggaccctgtggagaaatggaagatacaactcaacaatcatcaggatattctgaggacttaaatgaaattgagtattaagaaatgatctgcattggatttactagacgaaaaccatacctctcttcaatcaaaatgaaaacaaagcaaatgaatactggacagtcttaacaattttataagttataaaatgactttagagcaccctccttcattacttttgcaaaaacatactgactcagggctctttttttctttttgcatatgacaactgttactagaaatacaggctactggttttgcatagatcattcatcttaattttggtaccagttaaaaatacaaatgtactatattgtagtcattttaaagtacacaaagggcacaatcaaaatgagatgcactcatttaaatctgcattcagtgaatgtattgggagaaaaataggtcttgcaggtttccttttgaattttaagtatcataaatattttttaagtaaataatacggggtgtcagtaatatctgcagaatgaatgcagtctttcatgctaatgagttagtctggaaaaataaagtcttattttctatgttttattcatagaaatggagtattaatttttaatattttcaccatatgtgataacaaaggatctttcatgaatgtccaagggtaagtcagtattaattaatgctgtattacaaggcaatgctaccttctttattccccctttgaactacctttgaagtcactatgagcacatggatagaaatttaacttttttttgtaaagcaagcttaaaatgtttatgtatacatacccagcaacttttataaatgtgttaaacaattttactgatttttataataaatattttggtaagattttgaataatatgaattcaggcagatatactaaactgcttttatttacttgtttagaaaattgtatatatatgtttgtgtatcctaacagctgctatgaaattataaaattacctaataaaaataatttgaaaatcttaaaaaaaaaaaaaaa

SEQ ID NO: 330 - DNA, 4280 bp, Homo sapiens
  CDS (267)..(3410)
cgacgattccgtgagatgaacacatcgcgtttgcatcccagaaagtagtcgccgcgactatttcccccaaagagacaagcacacatgtaggaatgacaaaggcttgcgaaggagagagcgcagcccgcggcccggagagatcccctcgataatggattactaaatgggatacacgctgtaccagttcgctccgagccccggccgcctgtccgtcgatgcaccgaaaagggtgaagtagagaaataaagtctccccgctgaactactatgaggtcagaagccttgctgctatatttcacactgctacactttgctggggctggtttcccagaagattctgagccaatcagtatttcgcatggcaactatacaaaacagtatccggtgtttgtgggccacaagccaggacggaacaccacacagaggcacaggctggacatccagatgattatgatcatgaacggaaccctctacattgctgctagggaccatatttatactgttgatatagacacatcacacacggaagaaatttattgtagcaaaaaactgacatggaaatctagacaggccgatgtagacacatgcagaatgaagggaaaacataaggatgagtgccacaactttattaaagttcttctaaagaaaaacgatgatgcattgtttgtctgtggaactaatgccttcaacccttcctgcagaaactataagatggatacattggaaccattcggggatgaattcagcggaatggccagatgcccatatgatgccaaacatgccaacgttgcactgtttgcagatggaaaactatactcagccacagtgactgacttccttgccattgacgcagtcatttaccggagtcttggagaaagccctaccctgcggaccgtcaagcacgattcaaaatggttgaaagaaccatactttgttcaagccgtggattacggagattatatctacttcttcttcagggaaatagcagtggagtataacaccatgggaaaggtagttttcccaagagtggctcaggtttgtaagaatgatatgggaggatctcaaagagtcctggagaaacagtggacgtcgttcctgaaggcgcgcttgaactgctcagttcctggagactctcatttttatttcaacattctccaggcagttacagatgtgattcgtatcaacgggcgtgatgttgtcctggcaacgttttctacaccttataacagcatccctgggtctgcagtctgtgcctatgacatgcttgacattgccagtgtttttactgggagattcaaggaacagaagtctcctgattccacctggacaccagttcctgatgaacgagttcctaagcccaggccaggttgctgtgctggctcatcctccttagaaagatatgcaacctccaatgagttccctgatgataccctgaacttcatcaagacgcacccgctcatggatgaggcagtgccctccatcttcaacaggccatggttcctgagaacaatggtcagataccgccttaccaaaattgcagtggacacagctgctgggccatatcagaatcacactgtggtttttctgggatcagagaagggaatcatcttgaagtttttggccagaataggaaatagtggttttctaaatgacagccttttcctggaggagatgagtgtttacaactctgaaaaatgcagctatgatggagtcgaagacaaaaggatcatgggcatgcagctggacagagcaagcagctctctgtatgttgcgttctctacctgtgtgataaaggttccccttggccggtgtgaacgacatgggaagtgtaaaaaaacctgtattgcctccagagacccatattgtggatggataaaggaaggtggtgcctgcagccatttatcacccaacagcagactgacttttgagcaggacatagagcgtggcaatacagatggtctgggggactgtcacaattcctttgtggcactgaatgacatttcaactcctctaccagataatgaaatgtcttacaacacagtgtatgggcattccagttccctcttgcccagcacaaccacatcagattcgacggctcaagaggggtatgagtctaggggaggaatgctggactggaagcatctgcttgactcacctgacagcacagaccctttgggggcagtgtcttcccataatcaccaagacaagaagggagtgattcgggaaagttacctcaaaggccacgaccagctggttcccgtcaccctcttggccattgcagtcatcctggctttcgtcatgggggccgtcttctcgggcatcaccgtctactgcgtctgtgatcatcggcgcaaagacgtggctgtggtgcagcgcaaggagaaggagctcacccactcgcgccggggctccatgagcagcgtcaccaagctcagcggcctctttggggacactcaatccaaagacccaaagccggaggccatcctcacgccactcatgcacaacggcaagctcgccactcccggcaacacggccaagatgctcattaaagcagaccagcaccacctggacctgacggccctccccaccccagagtcaaccccaacgctgcagcagaagcggaagcccagccgcggcagccgcgagtgggagaggaaccagaacctcatcaatgcctgcacaaaggacatgccccccatgggctcccctgtgattcccacggacctgcccctgcgggcctcccccagccacatccccagcgtggtggtcctgcccatcacgcagcagggctaccagcatgagtacgtggaccagcccaaaatgagcgaggtggcccagatggcgctggaggaccaggccgccacactggagtataagaccatcaaggaacatctcagcagcaagagtcccaaccatggggtgaaccttgtggagaacctggacagcctgccccccaaagttccacagcgggaggcctccctgggtcccccgggagcctccctgtctcagaccggtctaagcaagcggctggaaatgcaccactcctcttcctacggggttgactataagaggagctaccccacgaactcgctcacgagaagccaccaggccaccactctcaaaagaaacaacactaactcctccaattcctctcacctctccagaaaccagagctttggcaggggagacaacccgccgcccgccccgcagagggtggactccatccaggtgcacagctcccagccatctggccaggccgtgactgtctcgaggcagcccagcctcaacgcctacaactcactgacaaggtcggggctgaagcgtacgccctcgctaaagccggacgtaccccccaaaccatcctttgctcccctttccacatccatgaagcccaatgatgcgtgtacataatcccagggggagggggtcaggtgtcgaaccagcaggcaaggcgaggtgcccgctcagctcagcaaggttctcaactgcctcgagtacccaccagaccaagaaggcctgcggcagagccgaggacgctgggtcctcctctctgggacacaggggtactcacgaaaactgggccgcgtggtttggtgaaggtttgcaacggcggggactcaccttcattctcttccttcactttcccccacaccctacaacaggtcggacccacaaaagacttcagttatcatcacaaacatgagccaaaagcacatacctaccccatcccccacccccacacacacacacacatgcacacaacacatacacacacacgcacagaggtgaacagaaactgaaacattttgtccacaacttcacgggacgtggccagactgggtttgcgttccaacctgcaaaacacaaatacattttttaaaatcaagaaaatttaaaaagacaaaaaaaaaagaattcattgataattctaactcagactttaacaatggcagaagtttactatgcgcaaatactgtgaaatgcccgccagtgttacagctttctgttgcagcagataaatgccatgttgggcaactatgtcatagatttctgctcctcctctcttttaatgaaataacgtgaccgttaacgcaagtaactctttatttattgttcaccctttttttccttaaggaaaggactcttccaaatatcatcctatgaacagctcttcagaaagcccattgaaagttaaactatttaacgtgaaatccattaactggaataattgagtttctttatttttacaataaattcactgagtaaataaaaaaaaaaaaa

SEQ ID NO: 331 - DNA, 2499 bp, Homo sapiens
  CDS (222)..(1820)
gattgtggcgtgacccggcagcggcttcctccgttcgggcatcgctgtgcctcgggttcgcgccccgagtgagcagtcctggcccggagcgtcggtcctggtaatctgtaggaaaagcgctgcggcccagggggtaaagagagatcagcctctgtggactcggtgcttctcctggcaagtaaaccccaaggaggactgaccagttcttgaatttctataccatggcccttcgatcagtgatgttcagtgatgtatccatagacttctctccagaagagtgggaatacctggacttggaacaaaaggacttgtacagagatgtcatgttggagaactacagcaacttggtctcactgggatgcttcatttctaaaccagatgtgatttcctcattggagcaaggaaaagagccttggaaagttgtgaggaaaggaagaagacaatatccagatttggagaccaagtatgagaccaagaagttatctttagaaaatgacatttatgaaataaatttatcccagtggaagataatggaaagaattgaaaaccatggccttaagggtctcattttaaaaaatgattgggaatccacaggaaaaattgaaggacaggagagacctcaagaaggatacttcagtagtgtgaaaatgccatctgaaaaggtgtcctcttaccagaaacgcacatctgttactccacatcagagacttcattttgttgataaaccctatgaatgtaaggaatgtgggaaggcgttcagagtgcgccaacagcttacttttcatcacagaattcatactggtgaaaaaccgtatgaatgtaaggaatgtgggatggccttcagacagactgcacaccttactcgacatcagagacttcattctggtgaaaaactctatgaatgtaaggaatgtggggaagctttcatatgtggtgcagatcttagagtacatcagaaaatgcatattggtgagaagccctatgaatgtaaagaatgtgggaaggcttttagggtacgaggacaacttactctgcatcagaggattcatactggtgagaaaccctatgtgtgtaaagagtgtggaaaagcctttagacagtacgcacacctgactcggcatcagaagcttaatagtgctgacaggctctatgaatgcaaagaatgtgggaaggcctttttgtgtggctctggtcttagagtacatcacaaacttcatactggtgagaaaccctatgaatgtaaggaatgcgggaaggcctttagagtgcgacaacaactaacactccatcagagaattcatactggtgagaaaccctatgaatgtaaggaatgtggaaagacctttagccgtggttatcatcttattctccatcacagaattcatactggtgaaaaaccttacgaatgtaaggaatgctggaaagcctttagtcgctactcacaacttatttcacatcagagtattcatattggtgttaagccctatgactgtaaggaatgcgggaaggccttcagactactttcacaactcacacagcatcagagtattcatattggtgagaaaccttataaatgtaaggaatgtggcaaggcctttagattgcgccaaaaacttactctacatcagagcattcatactggcgaaaaaccctttgagtgtaaggaatgtaggaaggcctttagacttaattcatcccttattcaacatctgagaattcattctggtgagaaaccctatgaatgtaaggaatgtaagaaggcctttaggcaacattcacaccttactcatcatctgaaaattcataatgtaaaaatctaagaaagtcttttcaacttctgtgttatagaacattctatgaatgtagtaattaatctattttgctccatacatgcaactgcgttggcattagaggttttataccattaaaagagtgtgacaatgtattgtagtccatcatcactcaaacctgaaacttcagcatatttgttctaaaaactaatcctgttataagaatgagaaagacatttaccgtcatccctatcccatcactttgtgtcatactggacaagacgcttaactgctctgtgctataattttttaatttatgacatggtcatataagagtgcagcagtttgacacactttcaatcaagaggtggaatctacatccctctgtgactgcttcgcccagtagaatatggtagacgtactgctgtgctggtttcttgactcagactttactggtagggttacttcatctcatgaaatgacagaactgtcttgttacaaagtctggctactttgctgaagagaccacatgaagaggccctgaaactacgtagagagggagaggcacctgctgaaccctgtcttcttgacatccaccaagataccagacatttgagtgaaattttggatccaccagaccagccaccagctaaatgccagtgagcgacttggtaacctgaactgatgccatgtagaatggaagaattga

SEQ ID NO: 332 - DNA, 2107 bp, Homo sapiens
  CDS (16)..(1755)
aatttcgtccctgcgatgcagatctgtggatccagcgtagcatctgtagcagctgggacatcattccaggttttgggcccggtgtgttggcaacaactggatctgaagatggcagtcagggtgctttggggtggtctcagcctgctccgagtgctgtggtgtctccttccgcagacgggctatgtgcacccagatgagttcttccagtcccctgaggtgatggcagaggacatcctgggcgttcaggccgcgcggccctgggagttttaccccagcagctcctgccgctcggtgctcttccccctgctgatctctggttccaccttctggctgctcaggctctgggaggagctggggccgtggcctggcctggtgagcggctatgcgctgctggtggggcctcgactcctcctcactgccctttcctttgctctggacggggccgtgtaccacctggccccgccgatgggggcggatcgctggaacgccctggccctgctgtctggttcctacgtcaccctggtcttctacacaaggaccttctccaacaccattgagggactcctcttcacgtggctgctggtgctggtatcctcccatgtaacgtggggccctacacgcaaggagccggcgccgggtccacggtggcgcagctggcttcttggaggcattgtggctgctggcttcttcaaccggcccacctttctggcctttgctgtggtccccctctacctctggggcactcgtggagccacaaaccctggtttgaagtctctgacccgggaggccctggtgctgctccctggggcagccctcacagcagcggtgtttgtggccacggacagctggtatttctccagccccgctacatccaggaaccttgtcctgacacctgtcaacttcctgcactacaacctgaatccccaaaacctggcgagacatggcacgcacgcgcggctcactcacctggcagtcaacggcttcctgctcttcggggtgctgcatgcccaggccctgcaggctgcgtggcaacagctgcaagtcggcctccaggcctctgcacaaatgggcctcctgagggcactgggtgcccggagcctgctgtccagccccaggtcctatctccttctcctctacttcatgcctctggccctgctatctgcctttagccaccaggaggctcggttcctgattcccctcctggtccccctggtcctgctttgtagtccacagacgcagcctgtgccttggaagggcactgtggtcctcttcaacgccctcggtgccctcctcttcggctgcctgcatcaggggggcctggtgcctggcctggagtacctggagcaggtggtccatgcccctgtgctcccaagcacacccacccactacacactcctcttcactcacacctacatgcccccccggcacctcctacacctcccaggcctgggggcaccagtggaggtggtggacatgggggggactgaggactgggccctgtgccaaaccctgaaaagcttcaccagacaaccagcctgccaagtggctggtgggccatggctctgccgcctctttgtggtaacccctggcaccaccaggcgtgccgtggagaagtgcagcttccccttcaagaatgaaacacttttatttccccatctgaccctggaggatccaccagccctgtcctccttgctgagtggggcttggagggaccacctcagtcttcacattgtggagctgggggaagaaacctgacaatatgacagagcacccactgcccaagactcagccatagaagatgccgccccaccttctacttgggtagctgggctgggacgctgggacaggaccccgtcctccttcatgactcccactgctgcctctcctgggcatggctgttagctgttctgccttctgggtgagctggcactcttctccctgagaccaaagatttgacctgtcggtcttgatgtcaaggtccccaaagaccaggttaagtgacgacacctgtctgttcctgccctgttgcttccagccactgtgatgtttgaaatatgtgatagtacctggttgtgaaaaaagacaatgaactgctaaaaaaaaaaaa

SEQ ID NO: 333 - DNA, 1154 bp, Homo sapiens
  CDS (1)..(1068)
atgcccaggcctacactagccccagatcagggccatcaggacctgacaaatcattcatcacttgaggcaaaagatggccctgactcccctgaagatcatagccattcagtaaggcatcccagactcctttactcccttaccaaaaacactaatccatcgcagatacgacttagaaagagccttcagggctacctaataatgactaaaatttacgtagtgcttactctgtgccagcccctttactatgaatgttataacaataacctcatttctatgaatgttataacaataacctcacaacagccccatgatggcattatttctattgtttccattttgtatgataacattgagataatagttggagaaactgctgtcttttgcctacaactagccacaagggattttgaaaaccaggaaaaaactattttaactggagactgttgctatataaacccgctggtgcgccgaactgtccgatttcttggaatttatacatttggactgtttgctacagatatctttgtaaatgctggacaagtagtcacaggaaatctggccccacatttccttgccctgtgtaagcccaattatacagcacttggatgtcagcagtatacacaattcatcagtggggaagaggcctgtactggcaacccagatctcatcatgagagcccgaaaaacctttccatccaaagaagcagctctcagtgtctatgcagctatgtatctgaccatgtacatcaccaacacaatcaaagccaagggaaccagacttgctaagccagttctatgcttgggcttaatgtgtttggcatttcttactggactcaacagagtagcagaatatcgaaatcattggtcagatgttatagcaggctttctggttggaatatctatagcagtatttctggttgtgtgcgtggtgaataatttcaaagggagacaagcagaaaatgagcatatacacatggataatctggcacagatgccaatgatcagcattcctcgagtagaaagtcctttggaaaagaaccacatcactgccttcgcagaagtcacatgatatcgaagcagatggtttttcactgcattggacatcatccctttttaccatccattcataacacccaaagtttgtttgattgcaag

SEQ ID NO: 334 - DNA, 2390 bp, Homo sapiens
  CDS (244)..(2064)
gaccgcctcgattccggtcgaccccgcgtccgacagaaagcgctttaaggttcgtttcatgcagttggcttgtgggactctgagagatgctgctgcccatgacatgcgggaattatcatgatcaactacccagcttggatttcacccagtggccaagagctttgtgtgggagacggcaagggttggatttttcaaaagagtaaaccagacccgtgaccaaggtgtagactaagaagtggagtcatgcttcacacggccatatcatgctggcagccattcctgggtctggctgtggtgttaatcttcatgggatccaccattggctgccccgctcgctgtgagtgctctgcccagaacaaatctgttagctgtcacagaaggcgattgatcgccatcccagagggcattcccatcgaaaccaaaatcttggacctcagtaaaaacaggctaaaaagcgtcaaccctgaagaattcatatcatatcctctgctggaagagatagacttgagtgacaacatcattgccaatgtggaaccaggagcattcaacaatctctttaacctgcgttccctccgcctaaaaggcaatcgtctaaagctggtccctttgggagtattcacggggctgtccaatctcactaagcttgacattagtgagaataagattgtcattttactagactacatgttccaagatctacataacctgaagtctctagaagtgggggacaatgatttggtttatatatcacacagggcattcagtgggcttcttagcttggagcagctcaccctggagaaatgcaacttaacagcagtaccaacagaagccctctcccacctccgcagcctcatcagcctgcatctgaagcatctcaatatcaacaatatgcctgtgtatgcctttaaaagattgttccacctgaaacacctagagattgactattggcctttactggatatgatgcctgccaatagcctctacggtctcaacctcacatccctttcagtcaccaacaccaatctgtctactgtacccttccttgcctttaaacacctggtatacctgactcaccttaacctctcctacaatcccatcagcactattgaagcaggcatgttctctgacctgatccgccttcaggagcttcatatagtgggggcccagcttcgcaccattgagcctcactccttccaagggctccgcttcctacgcgtgctcaatgtgtctcagaacctgctggaaactttggaagagaatgtcttctcctcccctagggctctggaggtcttgagcattaacaacaaccctctggcctgtgactgccgccttctctggatcttgcagcgacagcccaccctgcagtttggtggccagcaacctatgtgtgctggcccagacaccatccgtgagaggtctttcaaggatttccatagcactgccctttctttttactttacctgcaaaaaacccaaaatccgtgaaaagaagttgcagcatctgctagtagatgaagggcagacagtccagctagaatgcagtgcagatggagacccgcagcctgtgatttcctgggtgacaccccgaaggcgtttcatcaccaccaagtccaatggaagagccaccgtgttgggtgatggcaccttggaaatccgctttgcccaggatcaagacagcgggatgtatgtttgcatcgctagcaatgctgctgggaatgataccttcacagcctccttaactgtgaaaggattcgcttcagatcgttttctttatgcgaacaggacccctatgtacatgaccgactccaatgacaccatttccaatggcaccaatgccaatactttttccctggaccttaaaacaatactggtgtctacagctatgggctgcttcacattcctgggagtggttttattttgttttcttctcctttttgtgtggagccgagggaaaggcaagcacaaaaacagcattgaccttgagtatgtgcccagaaaaaacaatggtgctgttgtggaaggggaggtagctggacccaggaggttcaacatgaaaatgatttgaaggcccacccctcacattactgtctctttgtcaatgtgggtaatcagtaagacagtatggcacagtaaattactagattaagaggcagccatgtgcagctgcccctgtatcaaaagcagggtctatggaagcaggaggacttccaatggagactctccatcgaaaggcaggcaggcaggcatgtgtcagagcccttcacacagtgggatactaagtgtttgcgttgcaaatattggcgttctggggatctcagtaatgaacctgaatatttggctcacactcacggacaattattcagcattttctaccactgcaaaaaaaaaaaa

SEQ ID NO: 335 - DNA, 2105 bp, Homo sapiens
  CDS (1)..(1926)
atgggggagggaagaggaagggaggtgggaggcggggccgaccaagagcaggagctggagtctgagccggtggttgcagcggaggcggtgatgtcggtgcaggttgtgtcagccgcggctgccgccaaggtgcctgaggtggagctgaaggacctgagcccctccgaggcggagtcgcaactaggactgagcacggccgccgtgggcgccatggcccccccggcgggcggtggagaccctgaggctccagctcccgccgcggagcggcccccggtccccggcccgggctcggggcccgccgccgctctcagccccgccgccgggaaggtgcctcaggcgtcggccatgaagcggagcgacccacatcaccagcaccagcggcaccgcgacggcggcgaggccctggtcagccccgacggcaccgtcaccgaggcgccgcgcacagtcaagaagcagatccagtttgctgaccagaagcaagaattcaacaaacgtcccaccaaaattggacgtcgctctttgtctcgttccatttctcagtcatctactgacagctacagctcagcggcttcatatacagatagctctgatgatgagacatcgcccagggacaagcagcaaaagaactctaagggaagcagtgacttctgtgttaagaacatcaaacaggcagagtttggacgaagagaaattgaaattgctgaacaagaaatgcctgcattgatggctttgaggaagagagctcaaggagaaaagcctttggctggagccaaaatcgtgggttgcacacacatcactgctcagactgctgtgcttatggaaactctgggtgctctgggggcccagtgccgatgggctgcctgcaacatctattccactctcaatgaagtggctgctgctctagcagaaagtggatttcctgtttttgcctggaagggagagtcagaagatgacttttggtggtgtatcgatagatgtgtgaatgtggagggctggcagccaaacatgatcttggatgatggaggggatcttacccactggatttataaaaagtatcccaacatgtttaagaaaatcaagggcatagtagaggagagtgttactggagttcacaggctgtaccaactgtccaaagctgggaagctgtgtgttccagccatgaatgtcaatgactcagtcaccaaacagaaatttgacaacctctactgttgccgtgaatcaattcttgatggacttaaaaggacaacagacatgatgtttggtggaaagcaagtggtagtctgtggctatggagaggtggggaaagggtgctgtgctgccctgaaagccatgggctccattgtgtatgtaactgaaattgaccccatctgtgccctgcaagcctgtatggatggatttcgactggtgaaattaaatgaggtcatccgacaagtggacattgttattacctgtacaggtaacaagaatgtggtaaccagagagcacttggaccgtatgaagaatagctgcatcgtttgtaacatgggacattccaacacagagattgacgtggcgagtctgcggacaccagaactgacctgggagcgagtgagatctcaagttgaccatgtgatatggcctgatggcaagaggatagtactgctggcagagggccgcctgctgaaccttagctgctccacagtgcctacatttgtgctctcaatcactgctactactcaggctcttgccttgatagagctttacaatgctcctgagggtcgctataagcaggatgtctacctgttgcccaagaagatggatgagtatgtggccagcctacacctgcctacctttgatgcccacttgacagagctgacagatgaacaggccaagtatctgggactcaacaagaatgggcccttcaagcctaattactacaggtattaagttcctgtaactcaaaccagaatttttaaggaatagaactccaagccttttctccactactatacaagaaagaattcagcaagctgcttctccaatcaaagctgcctgccgtgctcaccctgtgtgttaggttatttatttattaaaatcaagaatcctgtgcctgcaaaaaaaaaaaa

SEQ ID NO: 336 - DNA, 1823 bp, Homo sapiens
  CDS (136)..(1476)
cggacgcgtgggcaaagctgtgtgaggaggaggaggaagtgagaggaggagccaggccccaggctggccgggagtggcccctcacactggttctccccactttctctgcctgtggcatcgaaggccccgggcaccatggcccaggccctgggggaggacctggtgcagcctcccgagctgcaggatgactccagctccttggggtccgactcagagctcagcgggcctggcccatatcgccaggccgaccgctatggattcattgggggcagctcagcagagccagggccgggccacccacctgcagacctcatccgccaacgggagatgaagtgggtggagatgacctcgcactgggagaaaaccatgtcccggcggtacaagaaggtaaagatgcagtgccggaaaggcatcccgtctgccctgcgcgcccgatgctggcccctgttgtgtggggcccatgtgtgccagaagaacagccctggcacctatcaggagctggcagaggcccctggagacccacagtggatggagaccattggcagggacctgcaccgtcaattccctctgcacgagatgtttgtgtcgcctcagggccacgggcagcaggggctcctgcaggtgctcaaggcctacaccctgtatcgaccggagcagggctactgccaggcccaggggcccgtggctgctgtgctgctcatgcacctgcccccagaggaggccttctggtgcctggtgcagatctgtgaggtctacctccctgggtactacgggccccacatggaggctgtgcggctggacgccgaggtgttcatggccctgctgcggcggctgcttccgcacgtgcacaagcacctgcagcaggtgggcgtcggacccctgctgtacctgcccgagtggttcctgtgcctcttcgcccgctccctgcccttccccacagtgctgcgtgtctgggatgccttcctcagtgagggtgccagagtactgttccgtgtggggctgacactggtgcgcctggcgctgggcactgcagagcagcgaggggcctgccctggcctcctggagacactgggagcccttcgagccatcccccccgcgcagctgcaggaggaggccttcatgtcacaggtgcacagcgtggtgctgtcagagcgggacctgcagcgggagatcaaggcccagctggcccagctgcccgattccgcgccgggacccccgccccggccacaggtccgcctcgccggggcccaagccatctttgaggcccagcagctggcaggagtgcgacgaggcgccaagcctgaggtgcctcggattgtggtgcagcccccggaggagcccagaccaccgcggcggaaaccccagacccgcggcaagactttccatgggctcctgactcgggcccggggcccccccatcgaggggccccccaggccccaacgaggctccacctccttcctggacacccgcttctgagaggaccatggacttagtgtcccccagtctcaattgcctgatggctgatgccagcccggcaaataggcaccgcactttactcttgggactcggggacttggcttccttcctggcaaggaccaggcagtggggaaggaggaggtcctccgtggtacatactgggtcaggcactagcatggaggagggtcacagagtggggcacgtgaggacccatggaaccgtcctggtgcccaggccctcacaagtaccaaagccagcaccaaaggagtcagggaaggggttggctgagtcaagggaccccagagggcaccaggaataaaatcttcttgaacagaaaaaaaaaaaaa

SEQ ID NO: 337 - DNA, 2089 bp, Homo sapiens
  CDS (69)..(1409)
ggccgggccgggccggggctgaggccgagcgagccgcggggcccgcgcagccccggccggagcccaccatgcggcggctgcggcgcctggcgcacctggtgctcttctgccccttctccaagcgcctgcagggccggctcccaggcctcagggtccgctgcatcttcctggcctggctgggcgtctttgcaggcagctggctggtgtacgtgcactactcgtcctactcggagcgctgtcgcggccatgtctgccaggtggtcatttgtgaccagtaccgcaaggggatcatctcgggctccgtctgccaggacctgtgtgagctgcatatggtggagtggaggacctgcctctcggtggccccgggccagcagtgggagggggatgtctgcacggaggacctctgtggccctgtccaggtgtacagcgggctctggcgggacaaggatgtaaccatcaagtgtggcattgaggacaccctcgactccaaggcccggtcggatgcggccccccggcgggagctggtactgtttgacaagcccacccggggcacctccatcaaggaattccgggagatgaccctcagcttcctcaaggcgaacctgggagacctgccttccctgccggcgctggttggccaggtcctgctcatggctgacttcaacaaggacaaccgggtgtccctggcggaagccaagtccgtgtgggccctgctgcagcgtaacgagttcctgctgctgctgtccctgcaggagaaggagcacgcctccagactgctgggctactgtggggacctctacctcaccgagggcgtgccgcatggcgcctggcacgcggccgcccttccacccctgttgcgcccactgctgccgcctgccctgcagggtgctctccagcagtggctggggcctgcgtggccttggcgggccaagatcgccatcggcctgctggagttcgtggaggagctcttccacggctcttacgggactttctacatgtgtgagaccacactggccaacgtgggctacacagccacctacgacttcaagatggccgacctgcagcaggtggcacccgaggccaccgtgcgccgcttcctgcagggccgccgctgcgagcacagcaccgactgcacctacgggcgcgactgcagggccccgtgtgacaggctcatgaggcagtgcaagggcgacctcatccagcccaacctggccaaggtgtgcgcactgctacggggctacctgctgcctggcgcgcccgccgacctccgcgaggagctgggcacacagctgcgcacctgtaccacgctgagcgggctggccagccaggtggaggcccatcactcgctggtgctcagccacctcaagactctgctctggaagaagatctccaacaccaagtactcttgatggggcagtgaggggcctggccacccttcctggagctggccaggtgccagggtccagccctccctcaaggaatcctgtcagaagatgtgaaatgcaactgtgttgcaaaatcactcccctaccgtcagggctctggattccagcaccacagacatgagaccccagctcggagcaaaggcggacatggacatcccggcaggagagtcctccaagggggtttgttactctgaagaacgtaatgtcaataaacagcttttatgtaatgcccagggctgagcaccctgagcccccatcgatgctgtgtgtgggacccttcgccccgctgtggatccacccagcccaggcactcaggctggggttgagcccctgaatccttcctggcgaggcagccctcaggtgttagtccaaggtgaggtctattgcagagctgcctgcccttcaacccacacacacctctgaagccgccagggcagttccccaaacacagcggcttctgaaacagtcaatgaccagtaccccccaaacctgggctgtgcacaacagaccaagaaaaaggtgttccagtaagaaaacagatatatgcggtattttaaaaactgattttacaaaatccagccatgagatgtacaactcattccctaggaaacagcccaggaatggccatcttctccagccccgta

SEQ ID NO: 338 - DNA, 2044 bp, Homo sapiens
  CDS (69)..(1364)
ggccgggccgggccggggctgaggccgagcgagccgcggggcccgcgcagccccggccggagcccaccatgcggcggctgcggcgcctggcgcacctggtgctcttctgccccttctccaagcgcctgcagggccggctcccaggcctcagggtccgctgcatcttcctggcctggctgggcgtctttgcaggcagctggctggtgtacgtgcactactcgtcctactcggagcgctgtcgcggccatgtctgccaggtggtcatttgtgaccagtaccgcaaggggatcatctcgggctccgtctgccaggacctgtgtgagctgcatatggtggagtggaggacctgcctctcggtggccccgggccagcaggtgtacagcgggctctggcgggacaaggatgtaaccatcaagtgtggcattgaggacaccctcgactccaaggcccggtcggatgcggccccccggcgggagctggtactgtttgacaagcccacccggggcacctccatcaaggaattccgggagatgaccctcagcttcctcaaggcgaacctgggagacctgccttccctgccggcgctggttggccaggtcctgctcatggctgacttcaacaaggacaaccgggtgtccctggcggaagccaagtccgtgtgggccctgctgcagcgtaacgagttcctgctgctgctgtccctgcaggagaaggagcacgcctccagactgctgggctactgtggggacctctacctcaccgagggcgtgccgcatggcgcctggcacgcggccgcccttccacccctgttgcgcccactgctgccgcctgccctgcagggtgctctccagcagtggctggggcctgcgtggccttggcgggccaagatcgccatcggcctgctggagttcgtggaggagctcttccacggctcttacgggactttctacatgtgtgagaccacactggccaacgtgggctacacagccacctacgacttcaagatggccgacctgcagcaggtggcacccgaggccaccgtgcgccgcttcctgcagggccgccgctgcgagcacagcaccgactgcacctacgggcgcgactgcagggccccgtgtgacaggctcatgaggcagtgcaagggcgacctcatccagcccaacctggccaaggtgtgcgcactgctacggggctacctgctgcctggcgcgcccgccgacctccgcgaggagctgggcacacagctgcgcacctgtaccacgctgagcgggctggccagccaggtggaggcccatcactcgctggtgctcagccacctcaagactctgctctggaagaagatctccaacaccaagtactcttgatggggcagtgaggggcctggccacccttcctggagctggccaggtgccagggtccagccctccctcaaggaatcctgtcagaagatgtgaaatgcaactgtgttgcaaaatcactcccctaccgtcagggctctggattccagcaccacagacatgagaccccagctcggagcaaaggcggacatggacatcccggcaggagagtcctccaagggggtttgttactctgaagaacgtaatgtcaataaacagcttttatgtaatgcccagggctgagcaccctgagcccccatcgatgctgtgtgtgggacccttcgccccgctgtggatccacccagcccaggcactcaggctggggttgagcccctgaatccttcctggcgaggcagccctcaggtgttagtccaaggtgaggtctattgcagagctgcctgcccttcaacccacacacacctctgaagccgccagggcagttccccaaacacagcggcttctgaaacagtcaatgaccagtaccccccaaacctgggctgtgcacaacagaccaagaaaaaggtgttccagtaagaaaacagatatatgcggtattttaaaaactgattttacaaaatccagccatgagatgtacaactcattccctaggaaacagcccaggaatggccatcttctccagccccgta

SEQ ID NO: 339 - DNA, 2283 bp, Homo sapiens
  CDS (438)..(1904)
ttcctgctgctgaccaccctcttgctgctgattggtgtggtctgtgcctttgtcaccaaccagcgcacgcatgaacagatgggccccagcatcgaggccatgcctgagaccctgctcagcctctggggcctggtctctgatgtcccccaagtgttggtgtgagcattgggagcgcgatccacactcagctcaggagctccgtgtaccccttgcttggcggccgtgggcagtttgggccaggtcctgcaggtctccgtgcaccacctgcaaaccttgaatgctacagtggtagagctgcaggccgggcagcaggacctggagccagccatccgggaacaccgggaccgcctccttgagctgctgcaggaggccaggtgccctctgtggaccatgtcctgcaccagctaaaaggtgtccccgaggccaacttctccagcatggtccaggaggagaacagcaccttcaacgcccttccagccctggctgccatgcagacatccagcgtggtgcaagagctgaagaaggcagtggcccagcagccggaaggggtgaggacactggctgaagggttcccgggcttggaggcagcttcccgctgggcccaggcactgcaggaggtggaggagagcagccgcccctacctgcaggaggtgcagagatacgagacctacaggtggatcgtgggctgcgtgctgtgctccgtggtcctattcgtggtgctctgcaacctgctgggcctcaatctgggcatctggggcctgtctgccagggacgaccccagccacccagaagccaagggcgaggctggagcccgcttcctcatggcaggtgtgggcctcagcttcctctttgctgcacccctcatcctcctggtgttcgccaccttcctggtgggtggcaacgtgcagacgctggtgtgccagagctgggagaacagcgagctctttgagtttgcagacaccccagggaacctgcccccgtccatgaacctgtcgcaacttcttggcctgaggaagaacatcagcatccaccaagcctatcagcagtgcaaggaaggggcagcgctctggacagtcctgcagctcaacgactcctacgacctggaggagcacctggatatcaaccagtataccaacaagctacggcaggagttgcagagcctgaaagtagacacacagagcctggacctgctgagctcagccgcccgccgggacctggaggccctgcagagcagtgggcttcagcgcatccactaccccgacttcctcgttcagatccagaggcccgtggtgaagaccagcatggagcagctggcccaggagctgcaaggactggcccaggcccaagacaattctgtgctggggcagcggctgcaggaggaggcccaaggactcagaaaccttcaccaggagaaggtcgtcccccagcagagccttgtggcaaagctcaacctcagcgtcagggccctggagtcctctgccccgaatctccagctggagacctcagatgtcctagccaatgtcacctacctgaaaggagagctgcctgcctgggcagccaggatcctgaggaatgtgagtgagtgtttcctggcccgggagatgggctacttctcccagtacgtggcctgggtgagagaggaggtgactcagcgcattgccacctgccagcccctctccggagccctggacaacagccgtgtgatcctgtgtgacatgatggctgacccctggaatgccttctggttctgcctggcatggtgcaccttcttcctgatccccagcatcatctttgccgtcaagacctccaaatacttccgtcctatccggaaacgcctcagctccaccagctctgaggagactcagctcttccacatcccccgggttacctccctgaagctgtagggccttgtgggtgggttttccccaactcgcttaattgctccctgccagggattaagggagtggggtggggaggggctggggtctggggtttccagggcctaggagggcaggaaggcttggggacatggtggagtctgggtattgggtgtggcccatccagcagtggggctgacagccctgttctcccctccctccccttcacccgtttccttcttaatccctgacagggtgaggtgaccctgaggctgcctgtcctcccctttgatttagcctgggccacaggacttcggtagctcttgccccagagcccaggctggcatccaggcctggactgtccccagttccggcttacctggccccaccttgcctgctcctttcc

SEQ ID NO: 340 - DNA, 1756 bp, Homo sapiens
  CDS (575)..(1354)
cgaaatcattcttttattcctgatcctgtttcctgtttatttcatgaacttgtctgtaggcagcatggtgctgggcgctgcaggtgctcatgaatgcatgagacacagattccactcaggagagagaagacgaacacagacacagtacacggtgggaaggggcacttccatgtctgcagccagagagccctttcagaatctgacccaaaagatggccagtattctaagaaaaagcacatatgcttacgatgtgcaaacagctgaaggtgttctttcaactatagtaaaaggggtgtctcggtggccacaggcggcccagatgaaggtgctgctggggaaaatgtcaccacgctggtcttgggaggctccatgagagggaggtgggacttgagaggggcttacagcctgggtgagaggcaaagaggaggccagagaccttctgggtagagaggaccctcgggccaaggctcagaggtggatgaacgggggagccttaggtggaacagcacagggtggaacccggcagaggacaatgggagctgatggaggctaggccagagtggggccttcagtgatgcttgaaccccaggcttcagactccagaagagccaagggcaggtggcccggctgcagagcctgtggcaggcaggcctcactcactatacccttctgtgtcctttgcctgcagagacctgtctgggccgcagagaggagtctggaggtagggtccaagggccacgagccagtttgggctgctggaggggggcctggcaaggagggctctcggggaagcacctgtgggggtctgcttcctgaccccagggagctagaggcctccctccctccaggccccccgagccaggctgagccagccgctaggggcacggagcagtgcccaccttgcgcccagtgtggccagagcttcggccagaaggagctcagtgcgccgcaccagcgcgtgcatcgtggcccccggcctttcgctggtgctcagtgtcccaagagcttcacgcagcggaccacccccgccagccaccgtcgggcgcacgtggccgagtgcacctacacccgcgcccaatgcggcaagaccttcctccagcagtcgacgctcacacccactactgcgcgcacatcagggagaagccctacgagtgcgccaagctctttggccgcctgtccacgctgctggagcaccggcacatgcacacgggtgagcggcccttccagtgcacgcaatgtggctgctgcttcagccgcctgtccacgctgctggagcaccggcacacacacatcagcgagaagcccttccagtgtgcgcagtgcgacaagcgtttcacgcgtctggccaacctgaccgtgcaccagagagtgcacttgggcgagcgctccttccagtgcgcccagtacagcaggagattcatgcagaagcccggcttcctgcgtcatctgtgtggccactcgcaggagaagcactatccttgcagcccttgtggttcccatgatcagtggtgaaatatagtgattttcacctgtgcttccattctgaagttctggaaagaagtactggatggactgaagtccaggacaacgtcccaaagaaaggcagagtccaggtaggcttggaggaccaagccctggatgagcactggagggcagaggcctcagtgtccagcactgtgccctgcacatggaaagcccctacgtttgtggaatgaatgaataataaaaatgttttcataagtgaaaaaaaaaaaaa

SEQ ID NO: 341 - DNA, 4678 bp, Homo sapiens
  CDS (1)..(4137)
atggcaagcagccccaccaaagggttgacaatgagcgtcccagtggctcctaagaaatcatgttacactcagttgcgggacaacagaaatgcagcaagaaataataatgaaagcatcttaagtctgggagatacgaatgccaatcaaatcatgttggaggtcagctcctctcatgacgagtccaagacatgtgacctgggagatgaaattggaaatacaaattcaagtgagccagaaaaccgtacccatttccataaggaatttcaccaacttcagggctttgggaaaggctctcaggctggctctgccagcctgaaagattttagactttcttcaaccattcagagggaactcaatgaagagcacacagtggagagaggcacagatagcctgcagaccacgcggagtattcagggaccaagtctgtcgagttggaggaatgtgatgagtgaggccagtctagacgttttggctaaaagggatgctgaaattccccggcatgttcccaaggataaactggcaaagacccttgacaatgaggaactgaggaggcattctttggaaagagcaagcagctctgtagctgcagtcgggagcctgactccgcagcatccacagcctctatccctcgactcccgggaagcacggggtcagatacctgggggtggggaggggccacagaagacattgccagaccacgctgtcccggcagctttccctgcaactgacagtacctcagagggaaagagtgtgcgtcatcctaaaccatctacctcagaaagcaagcagagcactccctcagagacccaaacagtgggggcacatgtactgcaggtgtgcagtgagcacacatcacattccgcccatccagagcctgctctgaatttgactttggcatcgaaggaaatcccaagtaaactggaagcacaattaggtcagggaaagggagaggccaagctggatctgaaatatgttcctcccaggagagttgaacaggagggaaaggcagcccaggaagggtatctgggatgccacaaggaagagaatctgtcagccttggagggaagggatccatgtggggaagcacacccggaagccaccgatgcacttggccatctgctgaacagtgacctccaccaccttggggtgggaagaggcaactgtgaagagaagagaggagtcaacccaggggagcaggattctctccacaccacccccaaacagggctctgcttccttaggaggggctgataatcagcccactggcaaaatttcaccatgtgcaggtgagaagttgggtgaaaggacatccagcagcttttcaccaggtgacagtcatgtggcttttattcctaataatctgactgacagcaagcccttggatgtcattgaggaggaaaggcggttgggcagtgggaataaggacagtgttatggttttggtgttcaatccttctgttggagagaacaagacggaggtgcctgagtccctggaccctcaaagtggccgctcagaagcacgggaaagcaaagaggtcaccacatctgttgctgaaaacaggaaccttctagagaatgcagataagattgaaagcacctcagcaagagcagattcagttctcaatattccagcacccctccacccagagacaactgtgaacatgacctaccagcctacaacacccagtagcagttttcaggatgttagcgtgttcggtatggatgcggggtcccccttggtagttccaccccctactgatagtgcacgcttgttgaacacgtcccccaaagtgcctgacaagaacacttgccccagtgggatccccaagcctgtcttcacacattccaaggacacaccttcctcgcaggagggaatggagaactatcaggttgaaaaaacagaggagaggacagaaactaagcccatcattatgcccaagcccaagcatgtgaggcccaagatcatcacctacatcaggaggaatccccaggccctgggccaggtggacgcctcgctggttccagtggggcttccatatgccccgcccacatgtaccatgcctcttccccacgaagagaaggcagcaggtggtgacctgaagccatctgccaacctctatgagaaattcaagccagacctgcagaagccaagggtcttcagttccggattgatggtgtctggaatcaagcccccgggacatcctttcagtcaaatgagtgaaaagtttttgcaggaggttacagaccaccctggaaaagaagagttttgttctcctccctatgctcattatgaagtccctccaactttctatcggtcagccatgctccttaagccccagctaggattgggtgcaatgtcccgtttaccatctgcaaagagcaggattctgattgcaagtcagaggtcttcagcgagcgccatccacccaccaggacccataacaacagccaccagtctctacagttccgatccttcagatttaaagaaagcttccagttcaaatgctgcaaaatccaatctcccgaaatctggtctccgtcctcccggatactcacgtctcccggcagccaaactggcggcatttggctttgtccggagctccagcgtctcctcagtctccagcacccagtccggggacagtgcacagccagagcagggccggccagccacccgttcaacctttgggaatgaagaacagccagttctgaaggcatctctgccttctaaggacacacccaagggggccggccgggtggcccctccagcatcctccagtgtgacagcaccccgcaggagtttacttccagcgccaaaatccacttccacacccgctggaacaaagaaagatgctccgaaagatcaagatacgaataaacctgctgtttcatctcctaagagagtagcagcttcaaccaccaagcttcattcaccaggatacccaaagcagaggactgcggcagctcgaaatgggtttccgcccaagccggacccgcaggcccgtgaggctgagcggcagctggtgctgcggctgaaggagcggtgtgagcagcagaccagacagctgggcgttgcgcaaggggagctgaagagggccatctgcggctttgatgccctcgccgtggccacgcagcatttctttagaaagaatgaaagtgcccttgtgaaagaaaaagagctgtcaatcgaacttgcaaacatcagggatgaagttgccttccatacagcaaagtgcgagaaactacaaaaggagaaggaggagctggagaggcggttcgaggacgaggtgaagaggctgggctggcagcagcaggccgagctccaggagctggaggagcggctgcagctgcaattcgaggcggaaatggcgcgcctgcaggaggagcacggtgaccagctgctgagcatccggtgtcaacaccaggagcaggtggaagatctcaccgccagccatgatgctgctctcctagagatggaaaataaccacacagttgccatcacaatcctgcaggatgaccacgaccacaaagtccaagaattgatgtccactcatgagcttgaaaagaaagaattggaagaaaattttgaaaaactgcggctgtcattgcaggaccaggtggacacgctgaccttccagagccagtctctgcgggacagagcccgccgcttcgaagaggccttgaggaagaacacagaggagcagctggagattgcattggctccttatcagcacttggaagaagacatgaagagtctgaagcaggtattagaaatgaagaatcagcaaatacacgagcaagaaaagaagattcttgagctggaaaagctggcagaaaagaacattatcctagaagaaaagatccaggttctccaacagcagaacgaagacctcaaagcaaggattgaccaaaacacagttgtcaccagacagctgtcggaggaaaatgctaacctccaggaatatgttgagaaggaaacccaggagaagaagagattgagccgaaccaatgaagagctgctttggaagctccaaactggggacccgaccagtccgattaaactctcgcccacatctcccgtttaccgcggctcctcctcggggccctcctctccggccagagtcagcacaacacccagatgacgccactacacggcctgcgggagctccggcttctcgtcctccggtctccaccctgagggagcaccgacccggtgccgccggagctggccctgtgcgcatgctcagtagctgcgaatgcatcctaggcgcgtcctcctctgatccccgtgtaagactgccctggtgtcggcacttaggaatgtgtaaatggtaaagtctgatgtgcaaacgttttaccatagttagagccaaaagaaagacacttgcaattgttcttgagcaatgaactttcactgcagaatttcaggttagttacaaaaagctcagttttcaatatacattgaataatcattgtgtactgcaccgatatgtgtgtatatttagatatacgtatatacacatgctgcggttctgaatttcattttttataacatgaagtgctgacatattttagtgaaggtcagcagttttctaacttgtgcctaagaattattgggaaatgaaaatgcatttctatctagcttcccaggaatatttctacccaaaatagaaaaaaaaaaaa

SEQ ID NO: 342 - DNA, 1293 bp, Homo sapiens
  CDS (488)..(805)
gtaccggcccggaataccagggtcgctagatactgagaaagcagttgcatctgactgcgcctacgcccctctgtggtgtgaaagcagactacacagaaaacttgtccctcattagagagagagccacacttctcactgctcacaatgagaggccaaagattacccttggacatccagattttctattgtgccagacctgacgaagagccttttgcgaagatcatctactgttgaagaagcgaagcgcaagacgagcacatgcctctactatgaatacggcgacgaataggtgctggctgtcctacgggcccacagcgcgctcctggagaatatacacatcgagcagatggcccgacgccttcctgcaagggtgcaagggtatccatggagactggcctatagcacgttagagcacgggaccagcttaaagacgctctaccggaaatcggcatcactagacagtcctgtcctattggtcatcaaagatatggataatcagatttttggagcatatgcaactcatcctttcaagttcagtgaccactattatggcacaggcgaaacttttctctacacattcagccctcattttaaggtctttaagtggagtggagaaaattcatactttatcaatggagacataagttctttagaacttggtggtggagggggacgatttggtttatggctagatgctgatttataccacggacgaagcaactcttgcagcactttcaataatgatattctttccaaaaaggaagacttcatagttcaggatctggaggtgtgggcatttgattgaaattcagactgccttaaaatataacattaaaaagactgggttcgatcagccctcctaaagctggctggaaaaagaagccccagcccagcctgcctcatcccaccccaatgcttcctttctgccatcatctcagagcatgatcacattgcagaaagattctggaaggtccatgtagagggcagacattgaagaaagaaacttaaaatccaggttgttgaaaagactttgtactcccacttcctccaaatccatacagtgaggaatcagagtgtttatagatatatgagttgaatgcaatttttatttttggtaactgaaaaataagatactgtggatatatacatgccttgtgtatttatcagcataattttcattaccaaaatgtacagctattatttgccatggaaaaggttagtctcatttagaaaaatcgaaagtgcacagcacttaaagggaatatatgaggttttttttttaaaaaaaaaaaa

SEQ ID NO: 343 - DNA, 1675 bp, Homo sapiens
  CDS (882)..(1406)
ctgcgacttttaatctttgcccttccctttgacctctactgtctgctctcccctcccactagaaatacaagaaacccaagtttatcccttgctttgtgttccttccggatggagacattctcactggagactcagaggggaacattctcacctgggggcggagcccttcagattccaagaccccaggcaggggtggcgccaaagagacctatgggattgtggcccaggctcacgctcatgaaggttctatcttcgccttgtgtctccggagggacgggacagtgctgagtggtggcgggcgggaccgccggctggtacagtgggggcccgggttggtggccctccaggaggctgagattcccgagcacttcggggccgtgcgagccattgctgaagggcttggctctgagctgctggtgggaaccacgaagaatgcattgctgaggggagacctggcccagggcttctcccctgtaatccagggccacactgatgagctctgggggctctgcacacacccctcccagaaccgcttcctcacctgcggccacgaccggcagctctgcctgtgggatggggagagccatgcactggcctggagcatcgacctcaaggagactggtctctgtgctgacttccacccgagtggggcagttgtggccgtaggactgaacacggggaggtggttggttttggacacagagaccagagagatcgtgtctgatgtcattgatggcaatgagcagctctcagtggtccggtacagcccagtgactgtatttgcagatgggttgtacctggccattggttcccatgacaacgtgatctacatctatagtgtttccagtgatggtgccaaatccagccgctttggccgctgtatgggtcactccagcttcatcactcatcttgactggtccaaggatgggaatttcatcatgtccaattctggggactatgagattctttactgggacgtggctggaggctgcaagcagctgaagaatcgctatgagagccgagaccgggaatgggctacctacacctgtgtgctgggctttcacgtctacggcgtctggccggacggctccgatgggaccgacatcaactccctgtgccgctcccacaacgagcgcgtggtggcggtggccgacgacttctgcaaagtgcatctcttccagtacccgtgcgctcgtgccaaggcgccgagccgcatgtacgggggccacggcagccacgtgaccagcgtccgattcacgcacgacgactcgcacctcgtctcgctgggcggcaaggacgccagcatcttccagtggcgagtgctgggcgctgggggcgcggggccggcgcccgccacgccctctcgaaccccctccctgtcccccgcctcctccctcgacgtttgatcgctgcctggcgggaccgactggcccggcggcgtggccccgccccgccctgcccttccctgccctaatcccccacgactaggggccgactctttcctggactgacttcgagacattcccgatcgcgcattttcctggagggcgcgaacggcgcccctgcacacactgtttagacccgctggctgagccgggcagccccagcctaggccttgactcccgctgcctgctgaggggcaataaaccagaaccaaagtcgcaaaaaaaaaaaa

SEQ ID NO: 344 - DNA, 2083 bp, Homo sapiens
  CDS (872)..(1909)
aaacaacaaaaaaaaaagcccacgttcaatggcagcactattcaaaagatggaagcaactcaagtatccaaacgcgcatgagtgaacacatcgtggttcatccacagtggaacacgattcagccagaaaaaggaaggaaaccggcctgcaccgtgacttggatgcacctggaggagactgtgatgaacgaaagcagccagacgcaaaagggcaaggacggcctacgcggctgtaggctggaccctggcttggcctcacccttgggacatgaagggctggccggggtgaggctagaccatgagggctctgacaagaggaccaagcaccggggccccgagcctgccccgctggagactgaggccacctctgcccgcaggtctctgaaggtcggcctgcagatctccctggactactggtggtgcaccaatgttgtccttcgaggggtggaagagaacagcccaggctacttggaggtgatgtctgcgtctgcaagcgggcggctgatgccctggtggcaggggccatcagcaacgggggcctctacgtgaagctgggccaggggctgtgctccttcaaccacctgcttccccccgagtatacccggaccctgcgcgtgctagaggacagggccctcaagcggggcttccaggaggtggatgagttgttccttgaggacttccaggccctcccccacgagctcttccaggagtttgactaccagccaattgctgccgccagcctggcacaggtgcacagagccaagctgcacgatggcaccagcgtggctgtgaaggtgcagtacatcgacctgcgggaccgctttgatggggacatccacaccctggagctcctgctgcggctcgttgaggtcatgcaccccagctttggcttcagctgggtcctccaggacctgaaggggaccctggcccaggagctggacttcgagaatgagggccgcaacgcagagcgctgtgcgcgggagctggcgcacttcccctacgtcgtggtgccccgcgtgcactgggacaagtccagcaagcgcgtgctcactgccgacttctgcgccggctgcaaggtcaacgatgtggaggccatcaggagccaggggctggcagtgcattacttgagtgcgggggggcgggggcggatagcaaaaaagctcatcaaggcctttgctgagcagatattttacaccggcttcatccactcggacccacatcctggcaacgttctggtgcggaaaggcccggacgggaaagcggagctggtgctgctggaccacgggctctaccagttcctggaggaaaaggagctcatggctgcgggcccatccacacccagggaccgcgcagccctctgccagctgtggcgggccatcatcctgcgggacgacgccgccatgagggcgcacgcagccgcactgggggtgcaagattacctcctgttcgccgagatgctcatgcagcgccccgtgcgcctggggcagctgtggggctcgcacctactgagccgcgaagaggcggcctacatggtggacatggcccgcgagcgcttcgaggccgtcatggcggtgctcagggagctgccgcggcccatgctggtggtgctgcgcaacatcaacaccgtgcgcgctatcaacgtggccctcggcgcccccgtggaccgctacttccttatggctaaaagggttgtccggggctggagccgcctggcgggcgccacgtatcggggtgtttacggcactagcctcctgcgccacgccaaggtcgtctgggagatgctcaagtttgaagtggcgctcaggctggagaccttggccatgcggctgaccgccctcctggctcgtgctttggtccacctgagcctcgtgcccccagcggaggagctctaccagtacctggagacctagggtgcaacccgcccagggccggcggggcccttttcaccttgggctgacggaggtggcggggctaaaggtgtagacacccccgagccccgtgggcactcgcactggggggctgtgacagcagctgggccaggaggccgtgtaatgaccacacactcctttcaagcaaaaaaaaaa

SEQ ID NO: 345 - DNA, 2572 bp, Homo sapiens
  CDS (21)..(2282)
ccaacaccgcctttctcagcatggagacctttgagcccatcagccaagagcccctcagccaagccagctatgacaaagccccagacccagttcctgagctccaagactcgttctatgcagaactgcaacgtgcagagagcctccaagagaagagcataaaagaggccaagaccaaatgcaggacaattgcatccctgctcactgcagcccccaacccccactccaaaggggtacttatgtttaagaaacggcggcagagagccaagaagtacaccctggtgagcttcggggctgctgctgggacaggcgctgaggaggaggacggcgttccccccacgagtgagtccgagctggacgaagaagccttctctgacgcccgcagcctcaccaatcaatctgactgggacagtccctatctggacatggagcttgccagggcgggctcaagagcatcagagggccagggctctgggctgggagggcagctgagtgaggtctctgggcgaggggtgcagctctttgaacagcagcgccagcgcgcagactccagcacccaggaactggcacgggtcgaaccagcagccatgctcaacggggaaggcctgcagtcaccacctcgggcccagagtgctcccccagaggcagctgtgctcccacccagccccttgccggcgcctgtagccagccccagacccttccaaccaggtggtggagccccgaccccagctccaagcatctttaaccggtcagccaggccctttaccccgggcctacaagggcagcggccaactaccacctcggttattttccggcctttagcccccaaaagggcgaacgacagcctggggggcctcagccccgccccaccccccttcttgtcttcgcaggggcccacccctctgcccagcttcacttcaggggttcccagccacgcgccagtctctggttcccccagcaccccacgctcctcgggccctgtgacagccaccagctccctgtacatcccagcccctagtcggcctgtcaccccaggtggagctccagagccccccgctcctcctagcgcagctgccatgacctccaccgcttctatcttcctatctgcgcctttgcgaccctctgcgcgcccagaggcgcctgccccaggcccaggggctcctgagccccccagcgctcgcgagcagcgcatctctgtgccagctgcccgcacgggtatcctgcaggaggcccggcgccgggggacccggaagcagatgttccggccgggaaaggaggagacgaagaactcgcccaaccccgagctgctatcgctggtacagaacctggatgaaaagcctcgggccgggggtgcagaatctggtcctgaagaagatgctctgagcctcggggctgaagcctgcaacttcatgcagccagtaggggccaggagttacaagaccctgcctcacgtgacacctaagaccccccctccaatggctcccaagaccccgccccctatgactcctaagactccacccccagtggctcctaagcccccatctcgagggctccttgatgggctcgtgaatggggcagcctcttcggctggaatccctgagccaccaaggctgcagggcaggggtggggagctgtttgctaagcggcagagccgtgcggacaggtatgtggtggaaggtacacctggtcctggtcttggccctcggcctagaagtccttctcctaccccgtctctgcccccttcctggaaatattcacccaacatccgtgccccgcctcctattgcttacaacccactgctctctccctttttcccccaggcggcccgaactctccctaaggcccaataccaggggcctcgggcaacacccaagcagggcatcaaggctctagattttatgcggcatcagccctatcaacttaaaactgccatgttctgttttgatgaggttcccccgactcctggccctatcgcctcagggtcccccaaaactgcccgagtccaggagattcgccggttttccactccggcaccccagcccactgcagaacccctggctcccactgtgcttgccccccgagcagccactacactggatgagcccatctggagaacagaactggcctcagcccctgttcctagcccagcccctcctccagaggctcccaggggccttggggcttctcccagctcctgcggtttccaggtagccaggccccgattttcagccaccagaacaggattgcaagctcatgtgtggaggcctggggcagggcaccagtgaacaggcacaggtcccaggaccaaggagaggtggaacatccagttcctaaagttgcttctcctaccctatcccatcccctgtcacgcatctggaagctaaattgcctcctgccagagatggtttccaagttgatgtccccttcccccaccttcctcctcactctctacctccctgccgctttccaaccaagtatgtctgctttggtatctttgcctctttttgtctctgcatttcctttcctggatctctgtctttatttccaggcttctccacccatattcctccacaga

SEQ ID NO: 346 - DNA, 513 bp, Homo sapiens
  CDS (21)..(446)
agagcacgtcaggcggcgccatgctcagcgcccaggagcgcgcccaaatcgcgcaggtctgggacctgattgcgggccacgaggcgcaattcggggcggagctgctgctcaggctcttcacggtgtaccccagcaccaaggtctacttcccgcacctgagcgcctgccaggacgcgacgcagctgctgagccacgggcagcgcatgctggcggctgtgggcgcggcggtgcagcacgtggacaacctgcgcgccgcgctgagcccgctggcggacctgcacgcgctcgtgctgcgcgtggacccagccaactttccgctgctaatccagtgtttccacgtcgtgctggcctcccacctgcaggacgagttcaccgtgcaaatgcaagcggcgtgggacaagttcctgactggtgtggccgtggtgctgaccgaaaaataccgctgagccctgtgctgcgcaggccttggtctgtgcctgtcaataaacagaggcccgaaccaaaaaaaaaaaa

SEQ ID NO: 347 - DNA, 627 bp, Homo sapiens
  CDS (21)..(560)
agagcacgtcaggcggcgccatgctcagcgcccaggagcgcgcccaaatcgcgcaggtctgggacctgattgcgggccacgaggcgcaattcggggcggagctgctgctcaggtcggtagaggcggggtctccgggagctcaggaggtggagatgagggttttgggcgcgtgggccgccaacgccatccaaggtccttcgggtgcggatccccggggctctgggcggctcttcacggtgtaccccagcaccaaggtctacttcccgcacctgagcgcctgccaggacgcgacgcagctgctgagccacgggcagcgcatgctggcggctgtgggcgcggcggtgcagcacgtggacaacctgcgcgccgcgctgagcccgctggcggacctgcacgcgctcgtgctgcgcgtggacccagccaactttccgctgctaatccagtgtttccacgtcgtgctggcctcccacctgcaggacgagttcaccgtgcaaatgcaagcggcgtgggacaagttcctgactggtgtggccgtggtgctgaccgaaaaataccgctgagccctgtgctgcgcaggccttggtctgtgcctgtcaataaacagaggcccgaaccaaaaaaaaaaaa

SEQ ID NO: 348 - DNA, 1648 bp, Homo sapiens
  CDS (173)..(1177)
cgtagccggagcgcctggggaaggcggagatgaagaccacgccgccgcgcgccgggagctgctgagcctaccgccgccagagtccagttgacacttactttgacaaaggcaaatttggaagcaattacttgaggacagttcatatagcatctggacagtcaacacgggcaccatgaagcacttcctgagaatgttgatccaggtatgcctgtatttttactgtaaatttctgtggcgctgcctgaaatttgtaatgaggaagctaactggaagatgtgaactacaacggatctgttataataccaagccgggagcttctagaaccatgaaaatcgaaacatcactgagggattctaaaagtaagctgctgcagacttctgtgagtgttcaccccgacgctattgaaaaaactatagaagatatcatggaactgaaaaaaattaatcctgacgtaaatccacagctgggaatctctcttcaggcttgccttctgcaaatcgttgggtacaggaaccttattgcagatgtggaaaaactgcgtagagaggcctatgattctgataatccccaacatgaagaaatgcttttgaaattatggaaattcttgaagcccaatactccactggaatctcggatttctaagcagtggtgtgaaattggtttccaaggtgatgatcctaaaacagactttcgaggaatgggacttctgggactgtacaatttgcagtatttcgcggaaagggatgccacagcagctcagcaggtcctgtctgactctcttcatccgaaatgcagggatatcactaaagaagaaataagcaaattcagcaaagcagaatgggagaagaaaaggatggataaggcaattgggtactcatttgcaattgtgggcatcaatataactgacctggcatataatctactggtcagcggagctctaaaaacccatttctacaatatcgccccagaagctccaacattgtctcactttcagcaaacattctgctatttgatgcatgaatttcataagttttggatcgaagaggaccccatggacataatggaatttaatcgtgtgagggagaaattccgcaagaggatcatcaaacagctgcagaacccagacatggcgctgtgcccacattttgctgcctcggaaggtttaatcaacatgtagttgcccacgccggttttaatggataccctggaacactgcctcattgtcttgttagatctctgcttaggtcgcagctcacgcattgaatgcacacagtgattgtatgcatgccttttggtacagtgttttcatctcttggtcataattccgagatccccagagaccactgtttctggagtatctgtcatccagtgactgctcatattgtggcattatgcagtgttacatcttgccttgatacccaggtatggagagagttttctatttttttagactttttttcctctccctcataattcagcattaaagaattgtatttctctagctgtattttgtatgtaagaggtttagctgaatctcattctgtgaaagccttttaatttattgaaatgtttcatgactactgctgctagctcttcaagccaggttcatgcttggacctcattctgataaagtataagactttaaaat

SEQ ID NO: 349 - DNA, 1237 bp, Homo sapiens
  CDS (325)..(1176)
taagaaccgggcagcccggccgtggatcatcactatggggcaccggcccatgtactgctccaacgcagatctggacgactgcacacgacatgaaagcaaggtccgcaaaggcctccaaggcaagctgtacgggttggaggatcttttctacaaatatggagtggatctgcagctgtgggctcatgagcactcgtatgaacgactgtggccaatttacaactaccaggtatttaacggcagccgagagatgccctacaccaacccgcgagggcctgtccacatcatcacaggatctgctccacagccgggcctggcggggggaccatgggcgcctcggtctccaggggccgggccgcccgggtccccgcgccggagccggaacccgaagaggcgctggacctgagccaactacccccagagctgcttctggtggtgctgagccacgtccccccgcgcacgctgctcgggcgctgccgccaagtgtgccggggctggcgagccctggtggacggccaggccctgtggctgctgatcctggcccgcgaccacggcgccaccggccgcgcgctgctgcacctcgcccgcagctgccagtctcccgcccgtaacgccaggccttgccccctgggccgcttctgcgcgcgcagacccatcggacgcaactttattcgcaacccctgcggccaagaaggcctccgaaagtggatggtgcaacacggtggggacggctgggtggtggaggaaaacaggacaaccgtgcctggggccccttctcagacgtgcttcgtgacttcattcagctggtgttgcaagaagcaggtcttggacctagaggaggagggtctgtggccagaactgctggatagtggcaggattgagatttgtgtctctgactggtggggagcccgacacgacagcggctgtatgtacagactcctcgtccaacttctagacgccaaccagactgttctagataaattctctgctgtgcctgatcccatcccgcagtggaacaacaatgcctgccttcacgtcacccacgtgttctccaacatcaagatgggcgtccgctttgtgtctttcgaacaccggggccaggacacacagttctgggctggccactatggagcccgtgtgaccaactccagtgtgatcgtgcgagtccgtctgtcctagtccagcactacccttcttgcaagacagcctgactgtgccttccagggcctgggaccattgg

SEQ ID NO: 350 - DNA, 1238 bp, Homo sapiens
  CDS (149)..(838)
taggatattagattttggttttttctgaccccggcttccctttaaccttgccagggctgggcccaacggccccgggctttcaccccaacactcgggctcggcataaagcggccgccggccgccggcccccagacgcgccgccgctgccatggcccagcccctgtgcccgccgctctccgagtcctggatgctctctgcggcctggggcccaactcggcggccgccgccctccgacaaggactgcggccgctccctcgtctcgtccccagactcatggggcagcaccccagccgacagccccgtggcgagccccgcgcggccaggcaccctccgggacccccgcgccccctccgtaggtaggcgcggcgcgcgcagcagccgcctgggcagcgggcagaggcagagcgccagtgagcgggagaaactgcgcatgcgcacgctggcccgcgccctgcacgagctgcgccgctttctaccgccgtccgtggcgcccgcgggccagagcctgaccaagatcgagacgctgcgcctggctatccgctatatcggccacctgtcggccgtgctaggcctcagcgaggagagtctccagcgccggtgccggcagcgcggtgacgcggggtcccctcggggctgcccgctgtgccccgacgactgccccgcgcagatgcagacacggacgcaggctgaggggcaggggcaggggcgcgggctgggcctggtatccgccgtccgcgccggggcgtcctggggatcccccgcctgcctgccccggagcccgagctgcacccgagccgcgcgacccgcctgcgctgttcgccgaggcggcgtgccctgaagggcaggcgatggagccaagcccaccgtccccgctccttccgggcgacgtgctggctttgttggaaacctggatgccccttttgcctttggagtggctgccttaggagcccaaattacaaaggacaacttaccccgtttttgttaacaccgaggctttttggcctcagcacctttgaagtggttccttggcaaactgccttttctggaaaagggcacgggcgattccgacgggggcatttcttcgggttaaaaccgtcccccccccggcggcccttttcagcccctccctccatggaaggacccataagggtaaacccttttaggcaaacaggaggctttgcctaatgttaatttatttatttgtgaataaaatggactggtgtcaaaaaaaaaaaaaa

SEQ ID NO: 351 - DNA, 624 bp, Homo sapiens
  CDS (77)..(319)
ggtcgacgatttcgtctgacttgcagatgctgtgagatccagagctaagactccaggacatcccggaagccgaaaaatggaactgttgacattcagggatgtgaccatagaattctctctggaggagtgggagtttctgaaccctgctcagcagagtttgtataggaaagtgatgctagagaactacagaaacctggtctctctgggtcttactgtttctaagccagaactgattagccgtctggagcaaagacaggagccctggaatgtgaagagacatgagaccatagccaaacccccaggtaggttggatgaatgaaacacatgccacaggtgaaagctccaaaggccaagaaggaagacagacttcaagagttatttgagaagctctgctccaatggagatgatttttgaggaacgtgattgtttattcttgctcttgtacagaggcatcttctgtctaatgctcctaaattctctaaaaagtaaccttactttgaggttatagtgagagccaaagtcctcttcatggcttataagagactttattatctgactgccctttcattgtcttggggcacacagaaatatatgtgtatttttgaggaactctatgttaaacta

SEQ ID NO: 352 - DNA, 3245 bp, Homo sapiens
  CDS (402)..(2537)
cctgcaacaaagcgaggcttgcgcagggcgcaaaaaagcagtcagagggtggcgccttttttaaagaagtttccatcctctctgtcctaaagctcaggccgttccccacccccaccgctcgctagccttctgttcccagtcccctggcatgatctgatcgcctttgaagcaggtacccgcctcggtctccccatcagctccaggggcctctcagttgagtgggtggagccgacagaagccgcgggctgagctcaagggccgatgggaggggtcctgggggcgctaactgcgcaccgcggccatgacgctgggcagatcattcacagaagtctctgtctcctttcatctacagtcgcagctgttttccagacgccttgctcctcaggtcggggagtgatctgatggcccaggttcgagaaacttctttgccctccggctctggggtccgctggatctccggaggtgggggaggagcctctcctgaggaggcggttgagaaggcggggaaaatggaggaggcggcggcgggggctacgaaggcgtcttcgagacgtgaagccgaggagatgaagctggagccattacaagagcgtgagcccgcgccggaggagaacttgacgtggagcagcagcggcggcgacgagaaggtgctcccttcaatcccccttcgctgtcacagcagctcctcgcccgtttgcccgcgccgcaagccccgccctcggccccagccccgggcccgctcccgcagccagcctgggctctcggccccacccccgcctccagcccggcccccgcccccgccgccacccccgcccccacccgcaccgcggcccagggcctggcgtggatcccggcgcagatcccggcctgggtccaggcctcagacacggagaagctgctctggtgacctagacgggtcgggggatcctggcggcttaggggactggttgctggaggtcgagtttggtcagggtcccacaggctgctctcatgtggagagctttaaagtaggtaagaactggcagaagaacctgaggttgatctaccagcgtttcgtttggagtgggaccccagagactaggaaacgtaaagcaaagtcatgcatctgtcacgtatgtagtacccatatgaacagactccactcttgtctctcctgtgtcttttttggctgcttcactgagaaacatattcacaaacatgcagaaacaaagcagcaccatttagctgtagacctttatcatggggtcatatattgcttcatgtgtaaggattatgtatatgacaaagacatagaacagattgccaaagaaacaaaagaaaaaattttgagattattaacttccacctcaacagatgtttctcatcaacagtttatgacatcagggtttgaagacaagcaatcaacctgtgagacaaaggaacaggagccaaaattggtgaaacccaagaaaaagagaagaaaaaagtcagtctatactgtaggcctgagagggctaatcaatcttgggaacacttgttttatgaattgtattgtccaggcacttacccatattcctctactgaaagatttcttcctctctgacaagcacaaatgtataatgacaagccccagcttgtgtctggtctgtgaaatgtcttcgctttttcatgctatgtactctgggagccgaactcctcacattccctataagttactgcatctgatatggatccatgcagaacatttagcagggtacaggcagcaggatgcccatgagttccttattgcaatattagacgtgctacatagacacagcaaagatgatagtggtgggcaggaggccaataaccccaactgctgtaactgcatcatagaccaaatctttacaggtggcctgcaatcagatgtcacatgtcaagcctgccatagtgtttctaccaccatagacccatgctgggacatcagtttggacttgcctggctcttgtgccacattcgattcccagaacccagagagggctgacagcacagtgagcagggatgaccacataccaggaatcccctcacttacagactgtctacagtggtttacaaggccagagcacctaggaagcagtgccaaaatcaaatgcaatagttgccaaagctaccaggagtctactaaacagctcacaatgaaaaaattacccattgtggcttgttttcatctcaagcggtttgagcatgtaggcaaacagaggcgaaagattaatacctttatctcctttcccttggagctggacatgactccgtttttggcctctactaaagagagcagaatgaaagaaggccagccaccaacagattgtgtgcccaatgagaataagtattccttgtttgcagtgattaatcaccatggaactttggaaagtggccactataccagcttcatccggcaacaaaaggaccagtggttcagctgtgatgatgccatcatcaccaaggctaccattgaggacttactctacagtgaagggtatttactgttctatcacaaacagggtctagagaaagactagtcttaccagaccacttactgaaaaaaaagtaaatgattaggcaaggattttgaagtgacacacagacctacttggaatggacaatgacagtaacacctatgtgacagctagtatcttgatataaagaacctattttagcatggcccatgggtctgtcggaagaaaaaaatgaatactaaccagtgaccattcaaccttaagaaatggggagagggagaagaggttgaaaatggtcacataaagcataatgaaatgaaaagaatgctttaggtggggacaacgggagtagaagtgttctgatgctactctatgtcatttgtttttacagaaatatcttgtgaagtcagggagtattcctttatcagcaaaaacttcacaattggtgttccagctgtggctgaccagctaaatagtttgaaagaaaaataatattttaaaataaagtttaaagagctttaaaagaaaaacatttaaaaaggaaaaaatcatttttaagattttaaaagaaaaaaacttttaaatgttgaaaaaaatttaagttgttatttttaaaagaaatattttaaaagttaaaaataattttttaatttaaagaagtttcagaattttaaaaattaaaagcaaagaaaattaaattcttaaagtttaaaaatgtaaaataaattaaggaacaaggttaaaaatgaaagtttaccaaaaaaaaaaaaa

SEQ ID NO: 353 - DNA, 1332 bp, Homo sapiens
  CDS (535)..(1218)
tgcatccctgtgggaactgccctccacctgctccctggggacacgtccaggtcgtacccgcagtgcgtccctgtgggaactgccctccacctgctccctggggacaagtccaggtcgtacccgcagtgcgtccctgtgggaactgccctccacctgctccctggggacaagtccaggtcgtacccgcagtgcgtccctgtgggaactgccctccacctgctccctggggacaagtccaggtcgtacccgcagtgcgtccctgtgggacctgccctccacctgctccatggggacaagtccaggtcgtacccgcagtgcgtccctgtgggaactgccctccacctgctccctggggacacgtccaggtcgtacccgcagtgcgtccctgtgggaactgccctccacctgctccctggggacacgtccaggtcgtacccgcagtgcgtccctgtgggaactgccctccacctgctccctggggacacgtccaggtcgtacccgcagtgcggagaggtcgggtcacagccagcagctatgtctgacataaatcttgactgggttgacaggcgtcagttgcagcgcttggaggaaatgctgattgttgtggatgagaatgataaggttattggtgccgacaccaagaggaattgccatctgaacgaaaacattgagaaagggctgctgcaccgagccttcagcgttgtcttgtttaacaccaagaatcgaatcctgatacagcagaggtcggacacgaaagtcacgtttcctgggtattttaccgactcctgtagtagccacccattatacaacccagcagaactggaagaaaaggatgccatcggagtgaggagggcagcccagaggcgtctgcaagcagagctgggaattcctggggagcagatttctccagaggacattgtgttcatgacaatctatcaccacaaggcaaaatcagacagaatttggggagagcatgaaatttgttaccttctgcttgtgaggaaaaacgtcactctgaacccggatcccagtgaaacgaaaagcatcctctacctgtcccaggaggagctgtgggagctgctggagagggaggcgaggggtgaagtcaaagtcaccccctggctaagaaccattgccgagaggtttctgtaccggtggtggcctcacctggatgacgtgaccccgtttgtggagcttcacaaaatacacagagtgtgagaggcagggaggtcgagtcagccatgtgtaatgccctcagtgcaggcagacgcaccattgaggcaatgatacaccctctccaaaaaacagggcaaaaggggcacccgggaattc

SEQ ID NO: 354 - DNA, 1401 bp, Homo sapiens
  CDS (345)..(1205)
ccagctggaggaattcccgctgctggcgagctgtgccccacgctcccgctgcaacagtcccgggcatcgcagctgccagtcaaggctaggaggcggtcggggactccgcctcctcccgacccgtaggtctgggagcgcaagtcctgttgcagtcttgcaaagtgtaaagctgtcagccgcagagcacggaggaaagacggagagaatggaagagctcctgtccggtgtgccagcagcccggactggcggtgagcgcgagggcggctactgagaagcccggcgacggaggaacgcaggtctgctgccagggattgaggagactgaagaacgctgaagacaggctgatgggctcagctggtaggctccactatctcgccatgactgctgaaaatcccactcctggagacctggctccggcccccctcatcacttgcaaactctgcctgtgtgagcagtctctggacaagatgaccacactccaggaatgccagtgcatcttttgcacagcttgcctgaaacagtacatgcagctggcaatccgagaaggatgtgggtctcccatcacttgccctgacatggtgtgcctaaaccacgggaccctgcaggaagctgagattgcctgtttggtacctgtggaccagtttcaactttatcagaggttaaaatttgaaagagaagttcatctggacccctaccgaacatggtgtcctgttgcagactgtcagacagtgtgccctgttgcctcgagtgacccaggacagcctgtgctggtggaatgcccttcttgccacctgaaattctgctcgtgttgcaaggatgcttggcatgcagaggtctcctgtagagacagtcagcctattgtcctgccaacagagcaccgagccctctttgggacagatgcagaagcccccattaagcagtgcccagtttgccgggtttatatcgaacgcaatgaaggctgcgctcagatgatgtgcaaaaactgcaagcatacattttgctggtactgcctccagaacttggatgtcccaccaggactcttacttggggtccatatccacaaggaggctgagcccatgagggtcctcttcaaggaggccgaatgttacggaacccactttgtgtcccccgaatgttccaatcccttggggttgaccacgtgccttggggcggaaatgtggcttgcaaacgacgacaacagctagctccagcagcccggatgcgagccgggcacctggaaaccttaacggctggccacgtgttaacagcgctgaataacacggactaccgatagcagcactcttttcacggcaaaggcgtctaagaccgcctcacgattgcagacgcaagcaactagtgatacagatgaaccaccagggagccccccatgagcagcgacga

SEQ ID NO: 355 - DNA, 1078 bp, Homo sapiens
  CDS (127)..(882)
tgtccggtgtgccagcagcccggactggcggtgagcgcgagggaggctactgagaagcccggcgacggaggaacgcaggtctgctgccagggattgaggagactgaagaacgctgaagacaggctgatgggctcagctggtaggctccactatctcgccatgactgctgaaaatcccactcctggagacctggctccggcccccctcatcacttgcaaactctgcctgtgtgagcagtctctggacaagatgaccacactccaggaatgccagtgcatcttttgcacagctattgcctgtttggtacctgtggaccagtttcaactttatcagaggttaaaatttgaaagagaagttcatctggacccctaccgaacatggtgtcctgttgcagactgtcagacagtgtgccctgttgcctcgagtgacccaggacagcctgtgctggtggaatgcccttcttgccacctgaaattctgctcgtgttgcaaggatgcttggcatgcagaggtctcctgtagagacagtcagcctattgtcctgccaacagagcaccgagccctctttgggacagatgcagaagcccccattaagcagtgcccagtttgccgggtttatatcgaacgcaatgaaggctgcgctcagatgatgtgcaaaaactgcaagcatacattttgctggtactgcctccagaacttggatgtcccaccaggactcttacttggggtccatatccacaaggaggctgagcccatgagggtcctcttcaaggaggccgaatgttacggaacccactttgtgtcccccgaatgttccaatcccttggggttgaccacgtgccttggggcggaaatgtggcttgcaaacgacgacaacagctagctccagcagcccggatgcgagccgggcacctggaaaccttaacggctggccacgtgttaacagcgctgaataacacggactaccgatagcagcactcttttcacggcaaaggcgtctaagaccgcctcacgattgcagacgcaagcaactagtgatacagatgaaccaccagggagccccccatgagcagcgacga

SEQ ID NO: 356 - DNA, 2179 bp, Homo sapiens
  CDS (455)..(1948)
atggcggatgggctgcaggagaaaggagggactgatgtggcttctacctgcgtcaagtggaccagagagagacagagatgccattattaccacattcatttcacagatggggcatggaacgcagcgacattaagtgacttgctcaaggccaacaacttggaagtggaggagctgggatttgaactgagcctgatgccggatgatgacacaaaccagcaagctaaggattcagtctgccccgtggggcgtctccggctgctcccattgagctgtctgctcgctgtgcccgctgtgcctgctgtgcccgcgctgtcgccgctgctaccgcgtctgctggacgcgggagacgccagcgagctggtgattggagccctgcggagagctcaagcgcccagctctgcccgaggagcccaggctgccccgtgagtcccatagttgctgcaggagtggagccatgagctgcgtcctgggtggtgtcatccccttggggctgctgttcctggtctgcggatcccaaggctacctcctgcccaacgtcactctcttagaggagctgctcagcaaataccagcacaacgagtctcactcccgggtccgcagagccatccccagggaggacaaggaggagatcctcatgctgcacaacaagcttcggggccaggtgcagcctcaggcctccaacatggagtacatgacctgggatgacgaactggagaagtctgctgcagcgtgggccagtcagtgcatctgggagcacgggcccaccagtctgctggtgtccatcgggcagaacctgggcgctcactggggcaggtatcgctctccggggttccatgtgcagtcctggtatgacgaggtgaaggactacacctacccctacccgagcgagtgcaacccctggtgtccagagaggtgctcggggcctatgtgcacgcactacacacagatagtttgggccaccaccaacaagatcggttgtgctgtgaacacctgccggaagatgactgtctggggagaagtttgggagaacgcggtctactttgtctgcaattattctccaaaggggaactggattggagaagccccctacaagaatggccggccctgctctgagtgcccacccagctatggaggcagctgcaggaacaacttgtgttaccgagaagaaacctacactccaaaacctgaaacggacgagatgaatgaggtggaaacggctcccattcctgaagaaaaccatgtttggctccaaccgagggtgatgagacccaccaagcccaagaaaacctctgcggtcaactacatgacccaagtcgtcagatgtgacaccaagatgaaggacaggtgcaaagggtccacgtgtaacaggtaccagtgcccagcaggctgcctgaaccacaaggcgaagatctttggaagtctgttctatgaaagctcgtctagcatatgccgcgccgccatccactacgggatcctggatgacaagggaggcctggtggatatcaccaggaacgggaaggtccccttcttcgtgaagtctgagagacacggcgtgcagtccctcagcaaatacaaaccttccagctcattcatggtgtcaaaagtgaaagtgcaggatttggactgctacacgaccgttgctcagctgtgcccgtttgaaaagccagcaactcactgcccaagaatccattgtccggcacactgcaaagacgaaccttcctactgggctccggtgtttggaaccaacatctatgcagatacctcaagcatctgcaagacagccgtgcacgcgggagtcatcagcaacgagagtgggggtgacgtggacgtgatgcccgtggataaaaagaagacctacgtgggctcgctcaggaatggagttcagtctgaaagcctggggactcctcgggatggaaaggccttccggatctttgctgtcaggcagtgaatttccagcaccaggggagaaggggcgtcttcaggagggcttcggggttttgcttttatttttattttgtcattgcggggtatatggagagtcaggaaacttcctttgactgatgttcagtgtccatcactttgtggcctgtgggtgaggtgacatctcatcccctcactgaagcaacagcatcccaaggtgctcagccggactccctggtgcctgatctctgctgggccg

SEQ ID NO: 357 - DNA, 2321 bp, Homo sapiens
  CDS (305)..(1381)
cgagctccagccctcagcgcatgccaggacgagtcgcctgagggaactgatctcagctcgggcccgcgttacatcctcctcctcttcttccttcggcccagctttccttaggggctgcaacccggacgccgaggccggtttcggagtggggagtgcccattttctctccttcccacgttcctggcccccagacgccatttgcaggcgggtggcttgggtcagcctccccgcccccacccgactcccgtcacgggagagcgcacaccgcgccccgagaaccaatcagcagccgcgttaggtaaccatgtctgagtctggacacagtcagcctggactctatgggatagagcggcggcgacggtggaaggagcctggctctggtggcccccagaatctctctgggcctggtggtcgggagagggactacattgcaccatgggaaagagagagaagggatgccagcgaagagacaagcacttccgtcatgcagaaaacccccatcatcctctcaaaacctccagcagagcggtcaaaacagccaccacctccaacagcccctgctgccccgcctgctccagcccctctggagaagcccatcgttctcatgaagccacgggaggaggggaaggggcctgtggccgtgacaggtgcctctacccctgagggcaccgccccaccaccccctgcagcccctgcgccacccaagggggagaaggaggggcagagacccacacagcctgtgtaccagatccagaaccggggcatgggcactgccgcaccagcagccatggaccctgtcgtgggtcaggccaaactactgcccccagagcgcatgaagcacagcatcaagttggtggatgaccagatgaattggtgtgacagtgccatcgagtacctgttggatcagactgatgtgttggtggttggtgtcctgggcctccaggggacaggcaagtccatggtcatgtcattgttgtcagccaacactccagaggaggaccagaggacttatgttttccgggcccagagcgctgaaatgaaggaacgagggggcaaccagaccagtggcatcgacttctttattacccaagaacggattgttttcctggacacacagcccatcctgagcccttctatcctagaccatctcatcaataatgaccgcaaactgcctccagagtacaaccttccccacacttacgttgaaatgcagtcactccagattgctgccttccttttcacggtctgccatgtggtgattgttgtccaggactggttcacagacctcagtctctacaggttcctgcagacagcagagatgggtgaaggcctccaacccatcccccagccacgagtccagcagctcatcgggctccgatgaaggcaccgagtactacccccacctagtcttcttgcagaacaaagctcgccgagaggacttctgtcctcggaagctgcggcagatgcacctgatgattgaccagctcatggcccactcccacctgcgttacaagggaactctgtccatgttacaatgcaatgtcttcccggggcttccacctgacttcctggactctgaggtcaacttattcctggtacccttcatggacagtgaagcagagagtgaaaacccaccaagagcaggacctggttccagcccactcttctccctgctgcctgggtatcgtggccaccccagtttccagtccttggtgagcaagctccggagccaagtgatgtccatggcccggccacagctgtcacacacgatcctcaccgagaagaactggttccactacgctgcccggatctgggatggggtgagaaagtcctctgctctggcagagtacagccgcctgctggcctgaggccaaggagaggaatgtcatgcaggggacctcctgggtccgcagtgtactgcgagggagcacagatgtccatcccccgctggggtggagagcggcagcaggcctgatggatgagggatcgtggcttcccggcccagagacatgaggtgtccagggccaggccccccaccctcagttggggctgttccgggggtgactgtgagcgatcccaccccaaacctgagatggggtagcccgtcctgtgtcctccacagggacaagcagtgggaggagtctgaatggtcaccaggaagcccgggctccatcttgacctcctttttcagggacaggagcaacaggcccctcttccctgactctaagcccttccctgtaaggtgaggcagggtctggagagctctttattggaacagatctggtggttcaaataaacacagtcatgcaaaaaaaaaaaaa

SEQ ID NO: 358 - DNA, 1474 bp, Homo sapiens
  CDS (231)..(1196)
gctagctccccgccgggctcgcgccgcagaggccggtgaggcgccggcggccacgccgcggaaggcgcgggccgagcagagccgggcgttggagcccgcgcgcgcatggaggcgttgccggcagccccctgagggcagcggggagacaagacccggcgacctcgcgcatccctcgagccgccacgcgctctcgccaccgggcggcgacgggccgcggagccggcgcggccatggcgacgggcggccagcagaaggagaacacgctgcttcacctcttcgccggcgggtgtggaggcacagttggtgctattttcacttgtccactagaagtcattaagacacggttgcagtcttcaagattagctctccggacagtctactatcctcaggttcatctggggaccattagtggagctggaatggtgagaccaacatccgtgacacctggactctttcaggttctgaagtcgatcttggagaaagagggaccaaagtcactttttagaggcttgggtccaaatttggttggagttgcaccatcaagggctgtatactttgcatgttactccaaagccaaagagcaatttaatggcattttcgtgcctaacagcaatattgtgcatattttctcagctggctctgcagcttttatcacaaattccttaatgaatcctatatggatggttaaaacccgaatgcagctagaacagaaagtgaggggctctaagcagatgaatacactccagtgtgctcgttacgtttaccaaaccgaaggcattcgtggcttctatagaggattaactgcctcgtatgctggaatttccgaaactataatctgctttgctatttatgaaagtttaaagaagtatctgaaagaagctccattaccctcttctgcaaatgggactgaaaaaaattccacaagtttttttggacttatggcagctgctgctctttctaagggctgtgcctcctgcattgcttatccacacgaagtcataaggacgaggctccgggaagagggcaccaagtacaagtcttttgtccaaacggcgcgcctggtgttccgggaagaaggctaccttgccttttatagaggactgtttgcccagcttatccggcagatcccaaatactgccattgtgttgtctacttatgagttaattgtgtacctgttagaagaccgtactcagtaacaggccggaaaattgtgctctagaagaataaaactgaaaaactctagagaattttttttccccattgatgtttagaaagtttgagactgaaacaggaaaggccataaaatatctggttcatatcacctgttggacatttctttttggattcatgctttctggaaggtttaaattcattaacgttaatagttaattataactttttttttaacttaagaggattcagggttaagcaccaactaaattaaatcatgctatttaatttaaaaaaaaaaaaa

SEQ ID NO: 359 - DNA, 656 bp, Homo sapiens
  CDS (184)..(603)
tgaacggaatgaatggttgttgtgtaatttggtttaagttttaattccatgagctctaccgaggagtaagtgcagcgtggcaattacgcctgtgtaggtgacactatagaacaagtttgtacaaaaaagcaggctggtaccggtccggaatttccgggatatcgtcgacccacgcgtccggccatgcgtccgtctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggacaaaaaaaaaaaa

SEQ ID NO: 360 - DNA, 1562 bp, Homo sapiens
  CDS (41)..(1117)
gagacgacgctcccagactcctccggtctccccgggcagcatgaagaccgccgagaacatcagaggaaccggcagcgacgggccgcggaaacgaggcctctgcgtcctctgtggcctccccgcggcaggaaaatcgactttcgcgcgcgccctcgcccaccggctgcagcaggagcagggttgggccatcggtgttgtcgcgtatgatgacgtcatgcccgacgcgtttctcgccggggcaagagcgcgaccggcgccatcccaatggaaattgcttcgacaggaactgttgaagtacctggaatacttcttgatggctgtcattaatgggtgtcagatgtctgtcccacccaacaggactgaagccatgtgggaagattttataacctgcttaaaggatcaagatctgatattttctgcagcatttgaggcccagtcttgctacctcttaacaaaaactgctgtttctagacctttgtttttggttttggatgacaatttttattatcagagtatgagatatgaagtctaccagctggctcggaaatattcattgggcttttgccagctctttttagattgtcctcttgagacctgtttacagaggaatggccagagaccacaggcactgcctcctgagaccatccacctgatgcgaagaaagctagaaaagcccaaccctgagaaaaatgcttgggaacacaacagcctcacaattccgagtccagcatgtgcttcggaggccagcctggaagtgactgatttattgctcactgctttggaaaatccagtaaaatatgctgaggacaatatggaacaaaaggacacagacagaattatttgttcaactaacattcttcataaaactgatcagacactccgaaggattgtatctcagacaatgaaggaagcaaaagatgaacaagtgcttcctcacaacttgaagcttctagcagaagaacttaaccagctcaaagcagagtttttggaagacctaaaacaaggaaacaaaaaatatctgtgctttcagcaaaccattgacataccagatgtcatttctttttttcattatgagaaagataatattgtacagaagtatttttcaaagcagcattaaaatttctgaactgccaatcaaatgtctcattttgaaagaaactgaagagacctgatgctcataatcaggaaaatcggcaaatggctgggactacaaccctggtctcttgaatcctgtttggaaatctgtgcgttaggagggaaatttccattcctacagcttcatgggaaaaggtctactccatttcaggaggtaacagtcctggcatgcacaattcaagccccctgcttcaccggttcctcactcctcactaggagaagtgattctgctggttgagacaagaccaatatccaagagggctacactgcattcgagggacaaggctcagtgtcttcctctctcccactgctttcccaagccagtcactatcacattttaatgtgtatgtgaattacttgggggatcttattaaaacacagattataattcagtaaaaaaaaaaaaa

SEQ ID NO: 361 - DNA, 2417 bp, Homo sapiens
  CDS (60)..(2108)
aaccttcaagaaacagatgccaagatgggattagatgtgcaagaaatgtattggaggaaatgcctatgggtgataaagaggaagaagcagaacatatctcctcattcctggccactggtaagaaactttccctccattttggtcatccacgtgagtgtgaagtcaccaggattgatgacaaaaatagaagaggattggaagacagtgagccaggtgccaaactcttcaataatgatggagtctgttgttgcctgcaaaaacgggggccagtgaacattacatcagtgtgtgtgagtcccaggaccttacaaatatcagtttttgtgttatcagagaaatacgagggtattgttaaatttgaatcggatgaattaccttttggtgtaattggttctaatattggtgatgcacattttcaagaattcagcctaggccccggccccccgccccggccccggccccggcgcggccctgggggcggatgcctggatgtggattttgccgtggggccaccaggctgttctcacgtgaacagctttaaggtgggagagaactggaggcaggaactgcgggttatctaccagtgcttcgtgtggtgtggaaccccagagaccaggaaaagcaaggcaaagtcctgcatctgccatgtgtgtggcacccatctgaacagactccactcttgcctttcctgtgtcttctttggctgcttcacggagaaacacattcacgagcacgcagagacgaaacaacacaacttagcagtagacctgtattacggaggtatatactgctttatgtgtaaggactatgtatatgacaaagacattgagcaaattgccaaagaagagcaaggagaagctttgaaattacaagcctccacctcaacagaggtttctcaccagcagtgttcagtgccaggccttggtgagaaattcccaacctgggaaacaaccaaaccagaattagaactgctggggcacaacccgaggagaagaagaatcacctccagctttacgatcggtttaagaggactcatcaatcttggcaacacgtgctttatgaactgcattgtccaggccctcacccacacgccgatactgagagatttctttctctctgacaggcaccgatgtgagatgccgagtcccgagttgtgtctggtctgtgagatgtcgtcgctgtttcgggagttgtattctggaaacccgtctcctcatgtgccctataagttactgcacctggtgtggatacatgcccgccatttagcagggtacaggcaacaggatgcccacgagttcctcattgcagcgttagatgtcctgcacaggcactgcaaaggtgatgatgtcgggaaggcggccaacaatcccaaccactgtaactgcatcatagaccaaatcttcacaggtggcctgcagtctgatgtcacctgtcaagcctgccatggcgtctccaccacgatagacccatgctgggacattagtttggacttgcctggctcttgcacctccttctggcccatgagcccagggagggagagcagtgtgaacggggaaagccacataccaggaatcaccaccctcacggactgcttgcggaggtttacgaggccagagcacttaggaagcagtgccaaaatcaaatgtggtagttgccaaagctaccaggaatctaccaaacagctcacaatgaataaattacctgtcgttgcctgttttcatttcaaacggtttgaacattcagcgaaacagaggcgcaagatcactacatacatttcctttcctctggagctggatatgacgccgtttatggcctcaagtaaagagagcagaatgaatggacaattgcagctgccaaccaatagtggaaacaacgaaaataagtattccttgtttgctgtggttaatcaccaaggaaccttggagagtggccactataccagcttcatccggcaccacaaggaccagtggttcaagtgtgatgatgccgtcatcactaaggccagtattaaggacgtactggacagtgaagggtatttactgttctatcacaaacaggtgctagatcatgagtcagaaaaagtgaaagaaatgaacactcaagcctagtatagttacacacagacctaccttcaatggaagatgacgacaccaatattacaactggcatcgagatctaaaggacctacttgaccatggcccatgggcctgacagagtaagaattgaacagtacccagtgtccaaaaggtcctgattggaagagaaatagaaggggagggagaagaggctctagtctaagcagttgatgaaagggaaattaaatggtagaaacactctgggtgaggaaggcaggagcaggaaaatgctgacactggtacatatcctatattcctccaaaagattgtgtagaaattgaa

SEQ ID NO: 362 - DNA, 2372 bp, Homo sapiens
  CDS (138)..(719)
tttcgtccgaaaggtctggtcgcagagacaggaacgtgtaatcctcagcgtgctccagcccacagcttcgctctactgctcggcagggcagctggcctctgggcaccggcggcccctctgcctcgcggaaaagcctgatgaagtcctccgatattgatcaggatttattcacagacagttactgcaaggtgtgcagtgcacagctgatctccgaatcgcagcgtgtggcccactacgagagtcgaaaacatgcaagcaaagtccgactgtattacatgcttcaccccagggatggagggtgtcctgccaagaggctccggtcagaaaatggaagtgatgccgacatggtggataagaacaagtgctgcacactctgcaacatgtcattcacttcagcggtggtggccgattcccattatcaaggcaaaatccacgccaagaggttaaaactcttgctaggagagaagaccccattaaagaccacagcaacacccctgagcccacttaagcccccacggatggacactgctccggtggtcgcatctccctatcaaagaagagattcagacagatactgtgggctctgtgcagcctggtttaataaccctctgatggcccagcaacattatgatggcaagaaacacaaaaagaatgcggcaagagttgctttgttagaacaactggggacaaccctggatatgggggaactgagagcctgaagaataagtagtgaaagcatcaatcaagacataagaacaaaacattagcatttctctgccgtggagaattgcttatcaaccaccagaggaggcttctttcttgaacaataaacatttcttataaggattcacagattcacatacgactgatcttgatttttggaaatgaatgaggtttcttttttctttttccttttttttaattttggggtaagttatgatatttggatggatttttaaattctttcctgataacatatttagcacatgttctaaattataatcctatagcaaacagttggagcattattcaaactgaaagtggaaaaatttaaatttccaatttattctagatttcctcagagcataattattctgttaaatcctcaatgagtgtgatgtaaaccacctctatccagaaatatacattcttttctcatcatgttggacacagttgagggtgacatgcacagaactggaacagatcactattagtggaaaataccaaatggacaaataaataccagtcgttttctccgttctccaagcacaggagccaggtttaccatctgaacaatgaagacgaagggagtaaataaaggaagaattctcatcttttttcctgatcattcaaagaacagtttctcaaggttaagccaagtcctccttgcaagttgccaaataatagcttaggaaaagaattagtctgcctgcatgatgatcttcttaggcaaaaacgtcttcacagcccttgaccttggtgaatttttttccccaaaagcatccaaaagaagaattataaaccccagaatgagatggaaataaacaagtatttttttttatgatgtttggcctgaactgtgggctttaattgggggatactgatcgtttggaaagaagtgagaaaattctgaagaaatggcggccttgggctaggcggggtcccctatttcttctgtttctcactgaagtcctactgctgagccaagactcagtcactctggaaagagcatgaccgataaagaaaacagttcctttctgatggggagcgtctgagtgcagatcatgaggctctttctctaggtttaattcttttccatggtgaccggacttggtgtcttgtagcctggttacgaagtgggacgttgagcttctactgacgatgccctgcatggaccagctgggatctggctggggctgccctgtgtccctaacgaccataggcaatccatcttcttgtgtcagcaatttctggacacccactgttttccaccaagagctgaggtggcaacaactcagtgagcaataaacaaaatgacacagaaatgcacagtgttgttatgaaggagcctgtttacctgtgttcaaaatctggcaccattcccttgagcagggcccgctcaggagggaccaggtctgccagtttctgtgcctgcagagagacgaagccccacgagccacaccctactctacaagaggaaagggggttggatgggaagaatctattttgctgttttggaaagcacacagccgacctacaaacctcctgtgatggtgtttcttcggatgtgtaaaataaggctttatttgtcaattccgctgtaaaataagcattgtccgagtaaaaacagcagcaacaacaaaaaaaaaaaa

SEQ ID NO: 363 - DNA, 1206 bp, Homo sapiens
  CDS (99)..(755)
  misc_feature (1)...(1206): n = a,t,c or g
cgagaaagaactccggaaactatcaatcaatacaaggctgccgttcggcggccttttttattcctagcaacagcactcgcacaaagcgaggtgagagtatgtatcgcatggacaaactaaccactggtgctgcctatggcgcttcagccgggagcatcctaaacggcatgttgaatgcctacagccccgagcagtggaacgctatcggcgtgctgacaaccgccgcagcaggagccgagatgaacccaacgttgaggaataagctggtgggtgccattgttggcggatcaggggcaatcactattgctgcagtaatgctgggcaatgcggatggactcgaaggtcggcgttattacgcctatcaggatgtggtcggcgtctggaccgtttgcgatgggcacactggtaccgacattcgccgcggtcaccgatataccgacaaagagtgtgacaacctgcttaaggcagatctgcgaaaggtggcaagcgccatcgacccgctgatcaaggttcgcatccctgagccaacccgcgccgcgctttactccttcacctataacgacagagatcatggaagttgggcccgactggatgagatttgggggtctttggaagtggagaatgtgtttgccctggggaagagagcatcttgtaaggagcaggtggagcatatggacaagccatccccaccagcccctgagacatgtgagagaggccagaacaggccatccggaccccactgtgctggtggatgagacagcagaaggaatatcaacctaccaacagaatcctgagaaatgctcactcttacttcaagctgctgcattttgatgttatgaaaccataaataacttatgaagtcatctttgctgacttaaagttttccataactttattataacatatcaaaattatgaaaaatgtgaaaagtagaaaactgatgaattttgcttcttcatatggtctttaagaatctcaaaggcactgaagttttttatcttttctgtcttagaataaaaaaccttgaatgaaaatctgcttcttggaaaagcagcaaggtttatgcagaggcaatctggtatttgtgtgcactggcagctgatcatacccagcatgcacgcactctcagggcagagtctgatgccccacataatggngcatggtaaggactcccatgtccttgagatnaaaatgataggaanatac

SEQ ID NO: 364 - DNA, 1727 bp, Homo sapiens
  CDS (327)..(1727)
tttcgtgagaacgcgagccgggagtccgtggaggccatggcccctcggcgcctcctgttggttggggaggggaatttctccttcgccgccgctctgagcgaaaccctggatcagagcactcaacttaccgccacctgcctccagcgcccggccgagttggctcgggatccactggcctgggagaatctgcagtgcctgcgcgagcgagctgtgcagacgttcttgcagaggaaggagaagtccacgtggcattatgtagaggacaaggtggaactcctgcggataagccccagagagaatggcacaacagttggcaagtggttgccatggcagccctgggggggctcattttaagcgacgtgtatccattcagctgtaaggctgtggcagggtacaagtgcactggatataggggtttcctggaagcaccttcatgtcatcctatcaaaaccataaatgagaaactcattgctgaattaggcaaagttttcccgctaaaaaggctgaagtgttcctaccctttgctgccacaggaaggtaccagtgttcttcctttctggaattgtgactttctgtcagctgctttttggattagtctccatgaagataactcaaattctgagtccctgactggtgggacatcacaagatgtggaagactttctagtgtcattttcagaacttagccttctcaagaatcctggaagagatggtaaagaagaagcttgtgaaggaacctgtggccaggccaagatctgccttagaccttctctcctagtgcatgttcaggatgtcatcgaagtaccagacttcctctcaggttctctgcacatcctcagtggacctgtctttcagaagtgccacattttgcctttcacaatgccagcatttcatgaaactttatttatccttggggttaatcaaaatctgaaggatggctgtcttcaatcactgctggatcatctgaagggcattctagatagcctgctgacccagacattgccggagagctctaagctgagcagtttagtcaaatttgtccttcagtcaaatggaaaggattatatgattcgtgtgaagactcataattttagcccagattgtactgaggatctaattattgggtctgttatcacatctgccactagtgttatacataaagaccagtgttttgtgtttgtgtctatgaacttggacttattagccatgcttgtctggtgtatctctgactggagaatgttgtggacgtttgataaccgtttcctgaaaaattttgtccctggcaaaatagaaccctttaaaagtcattctctgtatcctccatgttatgtgcatgatgttagtttttggatagatcagaagaaaggatttgatgaactagagtttcacactgtggcccgagcagtgtctcaggacactattatatccatacagtttcttagccgtttccagcatccaaagactcaacaggtcagtctctgctatagattgacctaccagacctgtgacaaggccctcacccagcagcaagtagcatcaatgcagtcccagtttaggaaggagattcaacaacacctatatgttatacctcgtagtgcttggtacatgtataaggtagcgtttgaaagctggatcttaaaacaagggcaggaatgtgaagggagaattgttaggcaagtagggtgtgcattttgggcagaggacatccataaacagagatatagataa

SEQ ID NO: 365 - DNA, 1631 bp, Homo sapiens
  CDS (581)..(1192)
  misc_feature (1)...(1631): n = a,t,c or g
gttggaattcgcagaacttttggaagagctgagtacaacacactgcgaaactacactcacagaagggaaaaaacagagagaaacattgaaagtggctggaaacagatttccgcactgtctcgttccacgcgctcacgccgatggagccaggggccccccgaccggacacgccaaggctcacgggatctccctgtcttctcgtgtgaacccgccccagttgtcgcaatgcctggagacctggacgtcctgcctatgaaggacgaggatgtgctcaagttccttgcggtaggagcccacgcaggcggcaccacccttggcttccagatggagcagtgtatccactaaaggacggaccagcgatggcatctntgtcataaatctgaagggacctgggagaagctgctgctggcagctcgtgccattgttgctgttgaaccctgctgaggtccctgtcttgctccaggaacactggccggcaggctgtgctgaagctcactgctgccaccagagccactccagctgctggccgcttctctcctggaaccttcactcgccagacccaggcagccttccgggagccatgtctgctggtcccaggcgaccaccagcctctcagagaggcgtcttggctagcccacctcccattgctctgtggaacacagattctcctctgtgctgtgtggaagtcgccatcccgtgcaacaagggagctcactcagtgggcctgaaggggtggctgctggctcagggagttctgggcatgcgtgacaccatcccccaggaacacccatgggagtccacgcctgacctctgcttctgcagagaccctgaagagattgaggtggaagagcagcctgctgctgatgcagctgtggccaagggggagtttcaggggaacagattgctccagtgcctgctgagcattgccgcccagcctgaggctgcagacccagcccctgtgcatactaccgctcagcccaagggtgcagacccagcccctgcacacactgccgcccaggttgagggtggagacccagcccctgcacgcactgctgctcagcctgaggctgcagactgctctgaaggtgcaggtaccccctgtgcctattcagccgtccctactgcagactggagcactcagcctgccaggcaagcctgttctgcagctcccaatgctcaggcccctgaatgaggaggatcaaccactgagcggtctcaagctgttcttccacaggccaccagcaagatggaaataaggccgatggaaaataaacatcagtttctatttaaaacaatgatattcgggtctgtttgcaatgtgattatttcatgaagtttaacagaattaccacatggcactgctctgagatgtgaagctgttttctacattttgggagattaaaaaaatgctttcccctaatatttcgagctagtttgaaaattataaatgttctcctttctttccaccaaagtgataaaagaaccaatgagtatacattgggcttactcagcatttattggttgtagttgaggcgttttgaggaaatacaaaggtgaatcctagtgatacaaaacccgtgacacagggtcaggtgcaatacattttgtgagggtcgcgcaaaaaaaaaaaa

SEQ ID NO: 366 - DNA, 2061 bp, Homo sapiens
  CDS (97)..(1206)
caacccggctgcattaaatcctgcctcattgcagtgtaagttggacgaaaaggatataccattctcagctacagacatcaagacaagtactgccagatgccatcctttgaagaaatatgtgttttcagtagaactcttttcattgttctgtttttcttgccttcggatgttactcaaaatagtgaacaacctgccccagaagaatatgatcaattacaatttgtgcttcaagaagagttttccagtgatgattcaacaacaaatgcacaatctgttatctttggaggctatgctttcttcaagttaacactctctaggagtcctttagtctcccaaccaggtaataaaggtagagaatttgtgccagatgaacaaaagcaaagtatccttccatctcccaaattttcagaggaagaaattgaacctttgcctcccacactagagaaaaagccctcagaaaatatgtccattcagctagactctacatttaaacaaatgaaagatgaagatctacaatctgctattgtacaaccttctcaaatgcaaaccaagcttctgcaggaccaagctgcgtcactccaagtttttccatcccattctgcactaaaactcgaagatatatcacctgaagacttgccatcccaagctctaccagtagaaggcctgtcagaacaaaccatgccatctaagtctacatcatcccatgtcaaacagtcttctaatctgacagctaatgacctgccccctcaaggcatactatcccaagacacatcatctcaagatatgctgtttcatgacatgacatcccaagatatgcaatccctagatatgctatctcaagacacaccatcccacgccatgccacctcaagacataccttcccaagatatgctatcccaagctctatcagcgcatgccatattacctgaagcctcaacatcccatattgtgcagttccctgaaatacaacacctacttcagcagcccccagatcttcaaccagaaaacactgaacctcaaaaccagcaaattttacaaatgtcatatcaagatattagatcagaagttatggaagagaccaaagaatggaaatctgaggaggaactccatagaagaaaatcctcaagacggcattccttaaaccagcaaaccaaagccttgcaatacttaaggagacattctttagacgtgcaagccaaaggctagaaatcctcaaagaggcattccttagatcagcaaagcaaaggctggcaatctccaaagcagaaatccttagaccagcaaatcaaagactggctatccccaaagaggcactccgtagataagcaagctcaacttaatcaaactaaagagcaactcccagatcagcaagctgaagatcagcaagccaaaggggaacaatacccagaaggacaatctaaagatggacaagttaaagaccagcagactgataaggagcaaaactcaaagaagcaaacccaggatcagcaaactgaagaccagccggcccaagagaagaaatccccgaaaggacaattccaaaatgttcaagccgaaggacagcaagctcagggctggagaaacaaagattataaagcacgagaatggcaatttgaaatgaagcactggcaaacacaggatctattagagaaagaagccctaaagcagaaagctctataccaagaagtccaaacccagcacgcaacagcccaacataacctagaatgtcaagacactcaagataaagaccaacaagaccttcaatccagagttacacaaaaaggagatatgtacactagagacatcaaaccaggggacatgaaatgtatagggcaaacctcaggggacctgcaatcagaagacgtgaaggcagattttcattcttcttctggccaaagctcagtacaagacacatgtttagcctatttgtccaatctagattcagaacaagatgtgcaaccagacacttcagcttcctcaaattcatataaagaagatgtgaatttaacttctacttcatgtgatccaaaagatcaacagcaatctgaagactctgactaa

SEQ ID NO: 367 - DNA, 2082 bp, Homo sapiens
  CDS (318)..(1967)
tttcgtccgactcccccctgttgccttattaccttccgaccacctctcggacctcttgcccagcccttccccgtagacatcaccccagatacggtggtgacaccattgctatgggcccacgtagggcgcagtgcgagccagggcaggacgcacttggtacgacccacgccgcgccccgcgccgccggaagtgaggtgtctgacccccgaagttccggttcgcagtgggtggggagtgttgttaaccggaggggcagccgcagtcgcgcggattgagcgggctcgcggcgctgggttcctggtctccgggccagggcaatgttccgcacggcagtgatgatggcggccagcctggcgctgaccggggctgtggtggctcacgcctactacctcaaacaccagttctaccccactgtggtgtacctgaccaagtccagccccagcatggcagtcctgtacatccaggcctttgtccttgtcttccttctgggcaaggtgatgggcaaggtgttctttgggcaactgagggcagcagagatggagcaccttctggaacgttcctggtacgccgtcacagagacttgtctggccttcaccgtttttcgggatgacttcagcccccgctttgttgcactcttcactcttcttctcttcctcaaatgtttccactggctggctgaggaccgtgtggactttatggaacgcagccccaacatctcctggctctttcactgccgcattgtctctcttatgttcctcctgggcatcctggacttcctcttcgtcagccacgcctatcacagcatcctgacccgtggggcctctgtgcagctggtgtttggctttgagtatgccatcctgatgacgatggtgctcaccatcttcatcaagtatgtgctgcactccgtggacctccagagtgagaacccctgggacaacaaggctgtgtacatgctctacacagagctgtttacaggcttcatcaaggttctgctgtacatggccttcatgaccatcatgatcaaggtgcacaccttcccactctttgccatccggcccatgtacctggccatgagacagttcaagaaagctgtgacagatgccatcatgtctcgccgagccatccgcaacatgaacaccctgtatccagatgccaccccagaggagctccaggcaatggacaatgtctgcatcatctgccgagaagagatggtgactggtgccaagagactgccctgcaaccacattttccataccagctgcctgcgctcctggttccagcggcagcagacctgccccacctgccgtatggatgtccttcgtgcatcgctgccagcgcagtcaccaccacccccggagcctgcggatcaggggccaccccctgccccccaccccccaccactcttacctcacccccccaactgcatgttcccactgtggccccccatgggcccctttccacctgtcccgcctccccccagctcaggagaggctgtggctcctccatccaccagtgcagcagccctttctcggcccagtggagcagctacaaccacagctgctggcaccagtgctactgctgcttctgccacagcatctggcccaggctctggctctgccccagaagctggccctgcccctggtttccccttccctcctccctggatgggtatgcccctgcctccaccctttgccttccccccaatgcctgtgccccctgcgggctttgctgggctgaccccagaggagctacgagctctggagggccatgagcggcagcacctggaggcccggctgcagagcctgcgtaacatccacacactgctggacgccgccatgctgcagatcaaccagtacctcaccgtgctggcctccttggggtgtgtctgtacaggggaagcagagtgggtttggtgggtcaggagtggagctgccaagaggtccccagcagtggttcttggcctttgacacctgccaattcaggctgcctatctacaggcccaccaagggtctccaggagttcttggtaactcctggtgcctttatttcctacttagatccagacatgctttctggagtggga

SEQ ID NO: 368 - DNA, 1796 bp, Homo sapiens
  CDS (321)..(1796)
ccgggacgacgatttcgtgtccccctggtgtcctttccacagatatttgctactttctcttgaagcacatgaggagaagccttagcaacctcaataccgaagttcttcgcgcgctcgctctttctgcctccgcccgaactatgcctgagtccctcacaggagttgggtagtagaggcgagagaaggaagtctttgcaggccaaaattgggacaacctgcttggacttccgcctcccggcctccggaaggcagtgcgcacgcgctcgctgcgactccggcgcggttgacttccgctcccactgtgctctgcgagccgaatcatggatcacactgacaatgagttacaaggcactaatagttctggatccttgggtggtcttgatgttcgcagacgaattcctataaagctcatctccaaacaagcaaacaaagcgaaacctgcaccgcgaactcaaagaactataaacaggatgcctgcaaaggctccacctggtgatgaagaaggatttgattataatgaagaagaacggtatgactgtaaagggggtgagctgtttgcaaatcagcgaagatttcctggacaccttttttgggactttcagataaacatcttaggtgaaaaggatgatacaccagttcatttctgtgacaagtgtggattgcctattaaaatctatgggagaatgattccatgcaagcatgttttttgctatgactgtgctattttacatgaaaaaaagggagataagatgtgtccaggctgtagtgatcctgtgcagcgaattgagcagtgtacacgaggttctctcttcatgtgtagcattgttcaagggtgcaagagaacatatttgtctcagagagacttacaggctcatatcaaccatcgccatatgagagctggaaaacctgttacccgtgcttcacttgaaaatgttcatcctcctattgccccaccaccaactgaaatccctgagcgttttataatgccaccagacaagcaccatatgagccatattccgccaaagcagcacatcatgatgccaccacctcctttgcaacatgtgccacatgagcactataatcagccacatgaggatattcgtgctcctccagcagaattgtccatggctccacctccacctcgatcggtcagtcaggaaacctttcgtatttcaacaagaaaacacagcaatttaataaccgtccctattcaggatgactcaaattcaggtgctagagaaccaccacctcctgccccagcacctgctcaccatcatcctgaatatcagggtcaaccagtggtatcgcaccctcatcatattatgcctccacagcaacattatgcaccacccccacctcctccaccaccaataagccatccaatgccacatcctccccaggctgcaggtactcctcacttggtatatagccaagctccacctccaccaatgacctctgctccaccaccaataacccctccccctggacatattattgcccagatgccaccttatatgaatcatcctcctccaggacctcccccacctcaacatggtggtccacctgtaactgcaccccctcctcaccattataatcctaactcattaccccagttcactgaagatcaaggaactctgagccctccatttacacaaccagggggaatgagtcctggtatatggcctgcaccaagagggccaccaccacctccacgattgcagggtccgccttctcaaaccccacttcctggaccacatcatccagatcagacaagatatagaccgtattaccaatga

SEQ ID NO: 369 - DNA, 1426 bp, Homo sapiens
  CDS (196)..(876)
aacgcgtccgatttccgagagagcgggagcgtctgtacctctgcggcgtcactgggagcccgacggaaaactgcgctaaaggcttgtctttcccctgcccgaccgaaggagccgaccttgcctgcgctacagcttccttattttcgtcgcctgttctcctgatcctgcgtgttctaaaaaccccttaggctttccatgggttcccagaccatggcggtggcgctgcccagggacttgcggcaggacgccaacctggcaaagaggaggcacgcggagctgtgcaggcagaagcgggtcttcaacgccagaaacaggataattgggggagacactgaagcctgggatgttcaagttcatgaccagaagataaaagaagctactgaaaaagctagacatgaaacctttgctgctgaaatgaggcaaaatgacaaaatcatgtgcatattggaaaaccggaaaaagagggataggaaaaatctctgtagggctatcaatgacttccaacagagatttcagaagccagaaactcgccgtgaatttgatctgtccgaccccctagcccttaagaaagatcttccagcccggcagtcagataatgatgttcggaatacgatatcaggaatgcagaaattcatgggagaggatttaaacttccatgagaggaagaaattccaagaggaacaaaacagagaatggtctttgcagcagcaaagggaatggaagaacgcccgtgctgaacaaaaatgcgcagaggccctctacacagagacaaggctgcagtttgacgagacagccaagcacctccagaagctggaaagcaccaccagaaaggcagtttgtgcatctgtgaaagacttcaacaagagccaggtataggtactccgcgacctcgggctcgacgactggaggggaggatgagcccactacggcttcccaaggctctccggcttccctgggatcccagtctcagcctgctccctggtcacatgaccggccctgacagagaccctgatgggctgcctgatgacagagatggatgagacccagtcctgtgccttagctctgaatcttggagggaaacctgccaaactagccatgtaacctggggaagtcagctcacctttctacacctcggtttcttcttctgtaacatgaggatggtgacatccacctagactgttaccgcctagctctgctccactgcctggtgctggtttccattcttcccacctctcagacttcccctttactgagaacagctacttggatgctcaccgatggcagggatgatgaagaagatcataatgagctcgaacactggggcctcctgagacctcccgcctcctctctaaactctggcccccctcctcccacacactcccctcccctccaacctgatgctgaaattgctgaaaaaaaaaaaaaa

SEQ ID NO: 370 - DNA, 1227 bp, Homo sapiens
  CDS (252)..(692)
gcccagctcactgaagagctttctggtctcttcattcatcttggtggctgggtcgtcgtaggatgccacgaacaccagggtgccttcgtgcagtggccgaataaacttcaacaggtcgttgacatctgggggggcaggtgccacggaacagggctgctgctcagagcaaattaggtcactacacagatgcgataaaggattgtgaaaaagcaatagcaattgactcaaagtacagcaaggcctatgggagaatggggctggccctcactgccttgaataaatttgaagaagcagttacaagttatcaaaaggcattagatcttgaccctgaaaatgattcctataagtcaaatctgaaaatagcagaacagaagttaagagaggtatccagtcctacaggaactggactgagctttgacatggctagcttgataaataatccagccttcattagtatggcggcaagtttaatgcagaaccctcaagttcaacagctaatgtcaggaatgatgacaaatgccattgggggacctgctgctggagttgggggcctaactgacctgtcaagcctcatccaagcgggacagcagtttgctcagcagatacagcaacaaaatcctgaacttatagagcaactgagaaatcacatccggagcagatcattcagcagcagcgctgaagagcattcctgatttaaccaggggctcaagcccaagatacaaatggtttatggctatgaatgaagtatttgttgtagatagtaccccctccctccttcaaaaaaccaaacaccatatctgatgtgtgaaaataatggaggaaaacctcttgtgtatattcttaaagaataaatctgtttagacaataggtttatcacaaacaaactcaaaacataacatgactccttttgaaatgatcactagccatgttacgtgccaatatagcactgggataaggttccattttcaaacttctatcatatttgtatattagacttaatagcaaagcatatttattgaactctagtagggctatttgttggtaagctctttagctccaatttcccttaagcaaagttttttgagaagggaaatgacccaaaggaaaggtttcctatgctggttgagaagaagtgtacttgccactgagcagtatgtcaggaaagaaggaatattatctaggtttagctttgataagtgatattagtaatgaatatataacctccgg

SEQ ID NO: 371 - DNA, 1915 bp, Homo sapiens
  CDS (187)..(465)
ttgcagcttattttctttttattgtatttaattccgaaagaatggtcacacttctttgctaggtaggcaagatgttccggaggacacactagagaaagcaccactccccaccctaacccacatccccaacacactcacctgcccacactcacacaatcacatacacatgcccacacttatatacacatgctgacacccgtgcactcatgtgcacacactcattcacactcatacatattcacactcaggcatactcatactcctcatgagcacaccacactcacctgtgcacactcacctgtgcacactcacacacatgcagacactcatgggcacactcacacatgctcacatgctcatttgcacccagacacaggcatacacatcatttgtatgcacacacgcacactttttaacgtggtaacgatttacaggaaagaacagctggaactcgtgctgggataaccaggtacaagtgctctctgcagagaataagtgcacacaggttggtgtcttctgaccgagagccctcctgaagggaggtctgtacctcctccctcatctcattttacacaaggcgacaggtcagaggccagggtgggacgagagcgagggagcactgtctctggcagcagcacttgccactccacaatgtggagaccagaacggcaccccagagagcacgggggaaatggctcatctttaaaacaatggcagaagaaatccagccaaggtcacttttcctgtgtgagcatgtttaaggccagagagtggctacttctctgcctcctgcagctccctcagtgtggcttggaggagtcggcgaagcttccagaacacgctggaggctgctctccgggtgttcccactggggaccccagggtctgcacattcctgcaccgcctcctgtaactgcagctgaagctggaaagagaccgcagagctcttgagaggcgcggaaaaccaatggcgaaatattttgtcacagatgacctgcaggttgttgtttacgcgctgcgctccgcatttgttgactcgtaaatcacatcttgaaaaacagtcaaagaaattgcagtcttcatctcctgtgcagttttgctcaaggatttccctcattttaggttcaaaaaaggccatgtccacatcaatagccaccactgtgaagtcgctccggatggcaaagttttccggcttgatgtcgcagaggtggaggcggtgggaaaagtcactgtcaaaatggttcaccatgtccaagaagctgagtgcgatgtcactgatggccttggcctggccacccccaggggcacctggggcccggtccagggggaagagtgccctgtggtgggggctgcccgcggccaggaactccaccgcgtagaagtggccgcaggaacccagcacgggcagcacgtgtgggctcaggtcctgcagcaggctgaagtagacgtactcctcctgctgcagcagggcccacaggctggccagctgtccccgccagcgtgggccccgcctgcccggccaccacggccccaggctgctgttggacaactccaggcccagagcgctcttgacctccccagccaccatcaggaggagttcggcctcgggcatgtcctggccaccctcccctgcctcctcttccaacaggctgaggggcgggaagctggagaaggcctcctccttggacttgaggaccacgggccggccgcgccagtcggcctgcagcaccttcttgcctctgttgtagtgcaggcagcgttggaacagcagctttcccgccacacacaggtcctcgcagaggtccccggccagcgtgccgccctggtagtcctggcacagcgcggccaggatgcgccggctcttctcgtcggtgcagcgctcggagaggacacccgggtgcgcgcggagcagcagc

SEQ ID NO: 372 - DNA, 1245 bp, Homo sapiens
  CDS (90)..(995)
cacagccgaagggaaagcagcaggttggggcttcttgtggccaacttcagagcctgtcaccaggaaaggtaagcatgggaggaaggaagatggcgacagatgaagaaaatgtctatggtttagaagagaacgctcagtcccggcaggagtccacgcggaggctcatccttgttgggagaacaggggccgggaagagcgccactgggaacagcatcctgggccagagacggttcttctccaggctgggggccacgtctgtgaccagggcctgcaccacgggcagccgcaggtgggacaagtgccacgtggaagtcgtggacactccggacattttcagctcccaagtgtccaagacagatcctggctgtgaggagagaggtcactgctacctgctctcggcccccggaccccacgcgctgctcctggtgacccagttgggtcggttcaccgcccaggaccagcaggcggtgaggcaggtgagggacatgttcggggaggacgtcctaaaatggatggtcatcgtcttcaccaggaaggaggacctggccgggggctccctgcacgattacgtgagcaacacagagaaccgggccttgcgcgagctggtggccgagtgcgggggccgggtctgtgcctttgataaccgggccaccggccgagagcaggaagcccaggtggagcagctgctggggatggtcgagggcttggtgctggagcacaagggcgcccattactccaacgaggtgtatgagctggcgcaggtgctgcgctgggcaggccctgaggagcggctccggcgggtggcggagcgcgtggcagccagggtgcagaggaggccatggggcgcctggctgtcggcccggctgtggaagtggctgaagtcccccaggagctggaggctgggcctggccctgctgctggggggcgcgctcctgttctgggtgctgctccacaggcggtggtcggaggccgttgcggaggtcgggcctgactgacagcgcaggtcctaaaactgaaggcaacttggttaagggaggctgaattcttggagctgaagggaaaacttcattccaacggaaggaatcctgtagtttcaggcatagttttaatgacacagaaaactttgctgcatcacctttgcaactttgccaaagctcagagttcactttttaagtttttaactcattttaaatgatgtgtatgcagagttttaaaataaattcgtctaacaataaaaaaaaaaaa

SEQ ID NO: 373 - DNA, 2141 bp, Homo sapiens
  CDS (433)..(1992)
ttggcctaacttaaatttttaaaacacttcctggaggggacaaacaggacccatctgctggtctgactctgggtgtcctgttcacagtctctgtcttagttgttctgtgtgtgggatgaagggtgccaaggagacagggcagggcagggaccctcaagaaaagcggggaggcggggggaagggatggtacaagcagccatggcacctcagtgtgtccctcaggcacctggacacacaggtgggcaaagatgctgacactgggggccagaaacgccgatacccccattcttccatttttactcagtctcaggtggtcccaaggaggggaccttcgtggccttgctgtgctcacaggctcacctttgtgtttccagctgcagagaaagtaccctgggccatgcagctgcactcccctcccaggaaaggggcaggatggctgcccagatgagtgaggcatcagccctggccccccaggtcttcccgagtccactggaactgatggtgggtgagcccagctccaagagccctggccagtgcttctgggggttctgctatgagaaggcagcagggccccgaggggccctggctcagctgcgtgagctgtgttgccagtggctgatgcctgaggcctgctccaaggagcagatgctggagctcttggtgctggagcagttattgggcacactgctcccagagatccaggcctacacgcaggagcagtggctaggcagccctgaggaggccactgccctggcagagcggctacagcaggagtcagctgggccaggactccagatgaaggagccgggctgccggtgcggggagtgcggcaaggcgttcagccagggctcttacttgctgcagcatcggcgcgtgcacacaggcgagaagccgtacacgtgccccgagtgcggcaaggccttcgcctggagctccaacctcagccagcaccagcgcatccacagcggcgagaagccctacgcttgcagggagtgcggcaaggccttccgcgcgcactcgcagctcatccaccaccaggagacacacagcggcctgaagcccttccgctgcccggactgcggcaagtccttcggccgaagcaccacgctggtgcagcaccgacgcacgcacacgggcgagaagccctacgagtgcccggagtgcggcaaggccttcagctggaactccaatttcctggagcaccggcgcgtgcacacgggcgcgcggccgcacgcctgccgggactgtggcaaggccttcagccagagctccaacctggccgagcacctgaagatccacgcgggcgcacggccacacgcctgtcccgactgcggcaaggccttcgtgcgtgtggcggggctgcggcagcaccggcgcacgcacagcagcgagaagcccttcccctgcgccgagtgcggaaaggctttccgcgagagctcgcagctcctgcagcaccagcgcacgcacactggtgagcggcccttcgagtgcgccgagtgcggccaggctttcgtcatgggctcctacctggcggagcaccggcgcgtgcacacgggcgagaagcctcatgcgtgcgcccagtgcggcaaggccttcagccagcgctccaacctactgagccaccggcgcacgcactcgggcgccaagcccttcgcctgcgccgactgcggcaaggccttccgcggcagttccggcctggcgcaccaccggctttcgcacacgggagagcgacccttcgcctgcgcagaatgcggcaaggccttccgcggcagctccgagctgcgccagcaccagcgcctgcactctggcgagaggccgttcgtctgcgcccactgcagcaaggccttcgtgcgcaagtcggagctcttaagccaccggcgcacgcacacgggcgagaggtcctacgcttgcggcgagtgcgggaagcctttcagccaccgttgcaacctcaacgagcaccagaagcggcacgggggccgcgctgcgccctgacccgaggacgccctgagcgggaggtcgcggacacacggcattgcggggtctcgggcgtgagtgcgctgtctgctggcccagactttttcgggccgccggtgcgggcgccctcctgctgggagtgcaggggcggccttgggtgtggagat

SEQ ID NO: 374 - DNA, 1125 bp, Homo sapiens
  CDS (127)..(687)
cacgaggccgcccgcaccgagccgcgggacccgggccgtaccggggaggggccgctccgggccgcagcgcgagggcatcgaggggcggcggggacctggcaccgggcggggccggcggcagcgaccatgatcgctttgttcaacaagctgctggactggttcaaggccctattctggaaggaggagatggagctcacgctggtcgggcttcagtactcgggcaagaccaccttcgtcaacgtgatcgcgtcaggacagttcaacgaggacatgatccccaccgtgggtttcaacatgcgcaaaatcaccaaagggaatgtgactatcaagctctgggacattgggggacagccgcgtttccgcagcatgtgggagcgctactgccgaggagtgagcgccatcgtgtacatggtggatgctgctgaccaggagaagattgaggcctctaagaacgagctccacaacctactggacaaacctcagctgcagggcatcccggtcttagtcctgggtaacaagcgagaccttccgggagcattggatgagaaggagctgattgagaaaatgaatctgtctgccatccaggaccgagagatctgctgctactccatctcttgcaaagaaaaggacaacattgacatcaccctacagtggcttattcaacactcgaagtcacggagaagctgagactccagcccttctccctcagaccagggaccgtcatcatctaaacctgaagccgagctccccgcccacccctgtcgtccccctaagcccacccctcctcacccagtgtgaggagggccctctggggaccccagagtcctgttctgctgaggtttgaactcctgtttttattgtaaaataaattgcccagggcccccacctccacggcccacttcattttctgttctcattttgcagagttgcacaaggagagaactcagcatggggggttggttctttgggttctgtttgtttatttgtttaatttaatgatttgtaaagtgatgttcctcttccttttttacacttttcagctcatatttaacctctgtttggaaaatgattcttgtaactgtacatttttttgcttcctaataacaatgacaacaaaaaaaaaaa

SEQ ID NO: 375 - DNA, 1959 bp, Homo sapiens
  CDS (1)..(1587)
atggccaagttgcctggactgggtccgcccctcctggggctccccgcatccaggtgccccgtgtgcccggcctgggcggctggccgtggatctgaccgctcctgcatggtggaggaccagcgttcccactgtctgcagctgtgccacctccctgtgccgggcttgctcttcgagcgggagaggacgggcctgacctaccgcgtgccctcgttgctccccgtgccccccgggcccaccctgctggcctttgtggagcagcggctcagccctgacgactcccacgcccaccgcctggtgctgaggaggggcacgctggccgggggctccgtgcggtggggtgccctgcacgtgctggggacagcagccctggcggagcaccggtccatgaacccctgccctgtgcacgatgctggcacgggcaccgtcttcctcttcttcatcgcggtgctgggccacacgcctgaggccgtgcagatcgccacgggaaggaacgccgcgcgcctctgctgtgtggccagccgtgacgccggcctctcgtggggcagcgcccgggacctcaccgaggaggccatcggtggtgccgtgcaggactgggccacattcgctgtgggtcccggccacggcgtgcagctgccctcaggccgcctgctggtacccgcctacacctaccgcgtggaccgccgagagtgttttggcaagatctgccggaccagccctcactccttcgccttctacagcgatgaccacggccgcacctggcgctgtggaggcctcgtgcccaacctgcgctcaggcgagtgccagctggcggcggtggacggtgggcaggccggcagcttcctctactgcaatgcccggagcccactgggcagccgtgtgcaggcgctcagcactgacgagggcacctccttcctgcccgcagagcgcgtggcttccctgcccgagactgcctggggctgccagggcagcatcgtgggcttcccagcccccgcccccaacaggccacgggatgacagttggtcagtgggccccgggagtcccctccagcctccactcctcggtcctggagtccacgaacccccagaggaggctgctgtagacccccgtggaggccaggtgcctggtgggcccttcagccgtctgcagcctcggggggatggccccaggcagcctggccccaggcctggggtcagtggggatgtggggtcctggaccctggcactccccatgccctttgctgccccgccccagagccccacgtggctgctgtactcccacccagtggggcgcagggctcggctacacatgggtatccgcctgagccagtccccgctggacccgcgcagctggacagagccctgggtgatctacgagggccccagcggctactctgacctggcgtccatcgggccggcccctgaggggggcctggtttttgcctgcctgtacgagagcggggccaggacctcctatgatgagatttccttttgtacattctccctgcgtgaggtcctggagaacgtgcccgccagccccaaaccgcccaaccttggggacaagcctcgggggtgctgctggccctcctgacaggccttctggccgtgcccatgccccttgggtgcctggggcagaggggtggaatacgttggggtgccccacgatagctgtggggggggctcttagtgcaggatcctgtggattagaaacaagttgctcctcagagctctcaagcagggactgctctttaggaaggggagcagcggctgggagtgagcagggcagggtgggggcagggtgggggcacgaagtgggccctgggtgacccccacagctcccttccgaggctgcagggccaggcgcgggaccgcaggtagcccagggtgttgtgggtggcagcacttgtttactggctgctttctggctcgaaataaaggaatcgtgcttgtgaaaaaaaaaaaa

SEQ ID NO: 376 - DNA, 1181 bp, Homo sapiens
  CDS (148)..(1152)
gaaaaggagaagtgaaggatgaccgcctcgctggaaccacaaaagagaggcttggaggggtttgtggtcccctctcagccaccccgaaatgatgtgcagaaatgaggcgatcctggcaacaggtggagtggggctcaaagtcagaaaatgagatacaagacatccttggtgatgaggaaacgattacggctttaccgaaacactcttaaagagtcaagtagcagctctggacaccatggcccccagctcaccgccgcctccagcccctcggtgttcccgggcctccacgaggagcctccccaggcctcccccagccgtcctttgaatggactcctgcgtctggggctccctggagacatgtacgcgcggccggagcccttcccgccagggcctgcggcccgcagcgacgccctggcagctgccgcagccctgcatggctacgggggcatgaacctgacggtgaacctcgctgcgccccacggtcctggcgctttcttccgctacatgcgccagcccatcaaacaggagctcatctgcaagtggctggcggccgacggcaccgcgaccccgagcctctgctccaaaactttcagcaccatgcacgagctggtcacgcacgtcaccgtggagcacgtcggcggcccggaacaggccaaccacatttgcttctgggaggagtgtccgcgccagggaaagcccttcaaagccaaatacaaacttgtaaatcacatccgcgtgcacacgggcgagaagcccttcccttgtcctttcccggggtgtgggaaggtctttgctagatcagaaaatctcaaaatacacaaacgaactcacacaggcgagaagcccttcagatgcgagttcgagggctgcgagcggcgcttcgccaacagcagcgaccgtaagaagcattcgcacgtgcacactagcgacaagccatacacgtgcaaggtgcggggctgcgacaagtgctacacgcaccccagctcgctgcgtaagcacatgaaggtgcacgggcgctcgccgccgcccagctctggctacgattcggctacaccgtctgccctcgtgtcgccctcgtcggactgcggccacaagtcccaggtggcctcctcggcggcggtggcggcgcgtaccgccgacttgagcgaatgatgtccaccgcgttgctcgcaaggtaatct

SEQ ID NO: 377 - DNA, 2647 bp, Homo sapiens
  CDS (124)..(2391)
  misc_feature (1)...(2647): n = a,t,c or g
tctgctattccggagtcgacgatttcgcgaggaccagtccatgtagctctcggaaccactgaaagctaccccttgtccttgaggacacctggaaccccagccccactgacccaccctggcaggatgagcttctcactcacgttcaccgagctggccaacatcgccatcccacagtgcggggtgcggaacttcaaggccctgcacctcctgctgcacggcatcttggagcacatccacatggccgagctcaagaaagtcctctcaggcgatgaggacttcctgcagacctcgcaggtggtcatcatgcccagggaaggagacgcccagcctatcctcaaccccatgaagaggctcagcaatgtcttcgaccacgtggtgagccgcctcgacaagttggagaaccagctggccctgctgcaggacctgccctccactgcccagctgctggaagccagccagggcactgcccggcccgtccaggacctgtggcatctgatcaagctccggaagatggtggagggtcatgatgaagtcatggccaagtcaatgcagaccctgcaggacttgctcactgatcttcatgcactccaggtcaccatcacagccctcagaaaagaagtggacatgctgaagaacatgcttgacaaggtacacccagaaagaatggacatctttgctgaagacttcaaaatacagaactggaagatggttgcactgcagcgggaagtggcttctctccagaataagtttaaaaccatccccaaaaccgaggacatggtgctctggagtggccttcatgatgccatgttcacctcagaaattggttcatcaccactggacctgtggcagtctgtagagcagctcccagaggctgccctggcccagaccaccaagtaccttgaagctactcgtgccatccaggtctccgagcccgtccaaaacccccagctactgcagactgtctggcattatgaggtcccagagctcctcccggagggctcatctgcccaagcagtttcactcagcagagcccaggagccagcgcagcctccggccctcacgcctgagtctgcacctgggtgcacaactgaatttgcacctgggcctgcacctgggactgaacctgtgccaggactggagctggggctggagctggagcctgtgcctgccctggggcctgtcccagggcccagtgtgacacctgggtccttgccagcaccttggcctgtgcttggacctgtgcctgccccaggtgtcctgcggccaactcagccccaaccctccagggccccaccaccagccactgagtttggctcattgggggctcgaccactccagccatatcagtctcgccagggagaagccctccagctcgcagctgtccaagtaaagggggaggaaaatgatgtccccagcctaaggggccttcgggagagggcccgcaaggatggggcccccaaggatagaactcgcaaggatggggtccccaaagatagaggtggcaaggatgtggaccccaaggatagagctcacaaggatgatgtccccaaagatagaggtggcaaggatgtggaccccaaggatagagctcacaaggatgatgtccccaaagatagaggtggcaaagatggggaccccaaggatagagttggcaaggatggggcccccaaggaagcacagcctaaggctccccagtctgcccttcaccggctgaaaaccaccgctgccatcgccgccgctgccgccgcagcctacgccgctgccacatcctccgctgcccaggcagccaaagttgctgccaagtttgtcaaggatgccccagccaccaaaatggccgccattgcaacagacacggctgcagctgggcccctaggggtctttgcagatgtcctgggtgcagggccttcccggggagccacagaatcccagatcttgggcgatgattccgaaatctacgaaatcctctctccctcctactctgctgccagcatcggtcccgatccagccctgtcccaggccatggtggctaccaagcaggccatgagccctgaagacaagaagagggctgtcaagtattccatgagccacatagcccagatacctgtcaaacacgactctctgaaggaagaatttgcccagctgtcctgtaacctgaaccagcgcttgagttatctagccaatatgggaggtccttccagcctcgggacaacagtggacatattgcagaaaaagattggcagcctccagaaatctaggctcaaggaggaagaacttgagagaatttggggcaaccaaatagagatgatgaaggatcgctacatcactttggacaaggcggtggagaacctgcagattcgcatggatgagttcaaggttaggaggactgggtaggctggagaagggctggcaaagggagaattcctcacctagaccttctggcccttcccgaaggttctgcatgaggaggggatgcacttgangctggnaaccactggggctttactggggttttactgtgtggaaattacacttcgatgattcccccaccattttcattatccccccggggggcggtattatcagaaggggcgggacacttttcggctttttgacacctgcgttccctgcccctgaaaggggaggggag

SEQ ID NO: 378 - DNA, 1449 bp, Homo sapiens
  CDS (1)..(1449)
atgagtcactgcagcagccgcgccctgaccctgctgagcagcgtgtttggtgcgtgtggcctgctcctggtaggcatcgcggtcagcactgactactggctgtacatggaagaaggcacagtgctaccgcagaaccagaccaccgaggtcaagatggccctgcacgccggcctctggcgagtctgcttctttgcaggtcgggagaaaggtcgctgtgtggcctcagaatattttcttgaaccggagatcaatttggtgacggaaaacacggagaatattctgaagacagtgcgcacggccacccccttccccatggtcagcctcttcctcgtgttcacggccttcgtcatcagcaacatcggccacatccgcccgcagaggaccattctggcttttgtctctggcatcttcttcatactatcggtcgccactggctgcctgagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccctctaccagttcgatgagaagtatggcggccagcctcggcgctcgagagatgtaagctgcagccgcagccatgcctactacgtgtgtgcctgggaccgccgactggctgtggccatcctgacggccatcaacctactggcgtatgtggctgacctggtgcactctgcccacctggtttttgtcaaggtctaa

SEQ ID NO: 379 - DNA, 1190 bp, Homo sapiens
  CDS (5)..(532)
acctatgaccccaacctcaggtggcagcacccctccgggcatcactgcaccagccgtgcctagcatcccatcccccattggggtgaatggcttcaccggcctccccccacaggccaatgggcaacctgctgcggaagctgtgttcgccaatggcatccacccctacccagcacagagccccaccgccgcggaccccctgcagcaggcctacgccggagtgcagcagtatgcaggtccagctgcctaccctgctgcctatggtcagataagccaggcctttcctcagccgcctccaatgatcccccagcagcagagagaagggcccgagggctgtaacctgttcatctaccatctgccccaggagtttggggacgctgagctgatgcagatgttcctccctttcggcttcgtgagcttcgacaacccggccagcgcgcagaccgccatccaggccatgaacggcttccagatcggcatgaagaggctcaaggtgcagctgaagcggcccaaagacgccaatcgcccgtactgagcgccggcgggagcgtcccccgggggagaccaggactcgcacagggcaggatgctgaacgggctacattaaaaaacaaacctctctctatatatatttataaatgagaactgttggatgacacctttgacatatcagccaatatcaatcaagctgaagactccagacactgtctgtgtgactgtaacatttcttcaaggaaagtatagcgtctatggagttcagagggcacgtgtttgggggaaaatatatatgacatgaagaagaagatgaagaaaaatgagaaaaaaacacacaaaaggcaactttaaaacaaaatatcacgagcagacggggaggctgaagggctgggagctgggaggagacgctgcttaccgatcccggggcttttccagcccacgggcgcctgacgcaggctggggcaagtggtgcgtggggcctggtccccaaggggcggctgagaggccgccactgagcatctctatctgtcattcctttagctatttagggaccaaaggaccaaactttttattgcagatgtgtagctctatgtcaaatagagggggaatggaggaccccctccttcctgcctcatggctgttcttgaaacagcttagagcgattctatgaaaaaatgtaataaaaaattaaaaaaaaaa

SEQ ID NO: 380 - DNA, 1250 bp, Homo sapiens
  CDS (5)..(592)
acctatgaccccaacctcaggtggcagcacccctccgggcatcactgcaccagccgtgcctagcatcccatcccccattggggtgaatggcttcaccggcctccccccacaggccaatgggcaacctgctgcggaagctgtgttcgccaatggcatccacccctacccagcacagagccccaccgccgcggaccccctgcagcaggcctacgccggagtgcagcagtatgcaggtccagctgcctaccctgctgcctatggtcagataagccaggcctttcctcagccgcctccaatgatcccccagcagcagagagaagggcccgagggctgtaacctgttcatctaccatctgccccaggagtttggggacgctgagctgatgcagatgttcctccctttcggtaatgtcatctcctcgaaagtgtttgtggatcgggcgactaaccaaagtaaatgctttggcttcgtgagcttcgacaacccggccagcgcgcagaccgccatccaggccatgaacggcttccagatcggcatgaagaggctcaaggtgcagctgaagcggcccaaagacgccaatcgcccgtactgagcgccggcgggagcgtcccccgggggagaccaggactcgcacagggcaggatgctgaacgggctacattaaaaaacaaacctctctctatatatatttataaatgagaactgttggatgacacctttgacatatcagccaatatcaatcaagctgaagactccagacactgtctgtgtgactgtaacatttcttcaaggaaagtatagcgtctatggagttcagagggcacgtgtttgggggaaaatatatatgacatgaagaagaagatgaagaaaaatgagaaaaaaacacacaaaaggcaactttaaaacaaaatatcacgagcagacggggaggctgaagggctgggagctgggaggagacgctgcttaccgatcccggggcttttccagcccacgggcgcctgacgcaggctggggcaagtggtgcgtggggcctggtccccaaggggcggctgagaggccgccactgagcatctctatctgtcattcctttagctatttagggaccaaaggaccaaactttttattgcagatgtgtagctctatgtcaaatagagggggaatggaggaccccctccttcctgcctcatggctgttcttgaaacagcttagagcgattctatgaaaaaatgtaataaaaaattaaaaaaaaaa

SEQ ID NO: 381 - DNA, 1649 bp, Homo sapiens
  CDS (460)..(1248)
  misc_feature (1)...(1649): n = a,t,c or g
aggcgcatttaacccagaaccctgccaagctttatccaagaggcatgttcccatttgggccttataggaaatttccgtcccacgaaaggcaggattaccaccttttgttttttttttagcagtttgagttggtgtagtgtatcctgggttatcagaatactcatatagctttgggattttgacttggtaaatattcatgatgtgtgaaaaatcatgatacatactgtacagtctcagtcccgtaaaactggatgtagtgcctacacacaggatctagaagaatatgtcaaactataaactgcttgtgattgtgaatgactttgttctttgcttgtgtttttcaatttcctataatgcacatactaaccgccgggccgcttgacgacgacgctcccgcgggggccccgccaaaaaaganaccgtccgaattcggcacgaggccgcgggaggccgcggaggatggaggagcggaaggaggagggcgaggccgagatccaggagcacgggcccgagcactggttctccaagtgggagcggcagtgcctggccgaggccgaacaggacgagcagctgccccccgagctgcaggaggaggcggctgcagagttggcagggctcaagagcgagaagcagaagctgtggcacctcttccagatctcggccaccgccgttgctcagctttacaaggattctgggtgccaacagcaaggactttccatgtgggaccccttccagaatgcggccatggccgtgaccagcctctacaaagagagcggggatgcccaccaacgaagttttgacttgggtgtccaggttggccaccagcgtcgcatcaaagatgtgctggagtgggtgaaaaagggccggagcaccattcgtcgcgaagacttgattagcttcctgtgtggcaaagtgccccccgctcctcctccacctcgcactcctaggacacccccgaagccacccactggggtcaccagccaggctgtggcaactgagtccagctcatcggtggacgtcgacctgcagcccttccaggaggcgatcgccctgcatggcctcagtggtgctatggccggcatcagcatgcgatcgggcgactcgcctcaagacagcggtgtcgccagcagtgggcgccgaaaaactagcttcttggaggacgacttgaatcccttcgactcagaggaactggccctccacctggacagtggggggatcccgcaagcgcacctcggcccaatgcagtgatggcatcacagactccccaatccaaaagcgcaaccgaatggtctaaactgcctcattggttgcctgccgccatattgcttgagagtgaactcaaccgtcgacatgcttgtctaaaggttactggagaccatttttcttcccttctctaagttaaacaaagatttctaacaattttgccataaagaaactttaaaagtattccagaagaggcttcatatgactctgactttccaaaaaatataatcctagcagagaacaaatatgtagtagttagcaggatcatttaaagcaaacgtatctggtcaaggcaggagtctgatttatcttgttcacagttatattcctcagcacctagcacagttccaggtgctcaataaatgttcattgaatgaaaaaaaaaa

SEQ ID NO: 382 - DNA, 1211 bp, Homo sapiens
  CDS (880)..(1200)
aaattttattataaagacctttattaggagaaaggacatattttctatttcttacttttattttgtgccttgaaggacttgtgaatgtatagaataattattttttcttactgcttcctctttgcaacccaacctccaccaagtcaatcgtgaaggtaggaagaaagctgtatttctgttacttttaaaaatgataacgagaagaaattaaaacaatggcttaagagaaagaggatgtaaggagtacaaagcaaaacttaacaaagagttagtaaaggaacttgcattgacaattcactcagccatgttaattttatcattaatactgtcttcatcatttttttttccaggtctctctgctcgtatttgcttggtgctccgaaatgcacgggaacagacagctatgggaaagctgcacagagcagttggcaatcaacatgtcctagaagggtgtgtggagtagcaaaacaagtggaacggatgaagaacttccaagctccttcgcagagttttgggccctagtgtgcagggctgctccctcatgagatggaggaaaatgtcgcccacacctacttggacctctcaccaaggacactgccctcagagataaatctgttggacggcagccaagagaccccaaattgtctcaacctccaggacacggcaagttgcaagtttccgagttggggaggcaaagcgggaaaacatgtttggcgatttcctcctgccactcaccgaccggagaaatggggaggcggactccaggtctttcgtggactgccaagagccctatagggcgtccagctataaaaagagaagaatcccatgaaggacaacaagcaaactcatatgttatccctttagccggattgtgtgctgatgattgtttccctatttacacttcgaatcacccctgtggtcttttgtgagtccccaaggcagcctcagccttcgcaaaccgtccagtggggcacgaatctcggaggggtgcgggctgcaggcggcagagggaagccaaagaggggcggcttttccaggccgtccacccccaggcgagctggtcctcacccttcgatcggctcgagtccctcggacagttgcccactcacagcgtgcaaaggggtcgcactccctgtgggttctccgccctcagaagccgcgctgcgcaggaaagtcacctccactacgggccgggagtagggaggggagcc

SEQ ID NO: 383 - DNA, 1706 bp, Homo sapiens
  CDS (92)..(1309)
gtggctgctgtccaccctgctggccaccccagagcctactgcctccctgctggggaacctcagacccccctcactccttcagggggaggtgatggggaccccttcctcacccaggggccctgagtccccccgactggcagcagggccctctccctgctggcacctgggagccatgcatgaatcaaggagtcgctggacagagcctgggtgttcccagtgctggtgcgaggacgggaaggtgacctgtgaaaaggtgaggtgtgaagctgcttgttcccacccaattccctccagagatggtgggtgctgcccatcgtgcacaggctgttttcacagtggtgtcgtccgagctgaaggggatgtgttttcacctcccaatgagaactgcaccgtctgtgtctgcctgctgggctcagtggcctgttcccccgtggactgccccatcacctgtacctaccctttccaccctgacggggagtgctgccccgtgtgccgagactgcaactacgagggaaggaaggtggcgaatggccaggtgttcaccttggatgatgaaccctgcacccggtgcacgtgccagctgggagaggtgagctgtgagaaggttccctgccagcgggcctgtgccgaccctgccctgcttcctggggactgctgctcttcctgtccagattccctgtctcctctggaagaaaagcaggggctctcccctcacggaaatgtggcattcagcaaagctggtcggagcctgcatggagacactgaggcccctgtcaactgtagctcctgtcctgggcccccgacagcatcaccctcgaggccggtgcttcatctcctccagctccttttaagaacgaacttgatgaaaacacagactttacctacaagcccggcaggagctcatggtccacactcactcgctttggggctgacagccactttcccaggggagcctggggcctcccctcgactctcaccagggccttcgacccctccaggagcccccactctacctctagcttccccaggggctcctcagccacctcctgtgactccagagcgctcgttctcagcctctggggcccagatagtgtccaggtggcctcctctgcctggcaccctcctgacggaagcttcagcactttccatgatggaccccagcccctcgaagacccccatcaccctcctcgggcctcgcgtgctttctcccaccacctctagactctccacagcccttgcagccaccacccaccctggcccccagcagcccccagtgggggcttctcggggggaagagtccaccatgtaaggaggtcactgtgtccgggagactctggagagaggacctctgccagtggcccagggtgtgtgcagggcagctccaaggatgaacctggtggggatgcctgggctccctcctgcaggggccctggtgaggatggaagacccccaaggctggatgtaaccttgttcccaagaagtgtttggaatgtgctgtaagaatggaggaagtcgtttccactgtcagcatcctccctggaccgcgtggctggctcatcttttgagaagggttgggactgccaagttctcctggaggaagagttgcgtccggctgggattccactcactgggactgtaccgccaggtgtcatgcgtctctctgaggtttcctgattaaaggttgtctcggtttcaaaaaaaaaaaa

SEQ ID NO: 384 - DNA, 1144 bp, Homo sapiens
  CDS (187)..(594)
ttaaaactcaacaataacaacaacagtaaaacaaacaactcgattgaaaaaataatcaaaagatctggacacctcatcaaagaagattgggaaaaggacttctaaaagataaatctgtttggaaggctgttttccaacgccacttttgatggctgtaagtgggatctctggaaccaaagggagcacatggctcttcttaaaactgaaggtatttgtgtccaagatgaaactgaattctgtttggccaagagatgtgcttctgtgtacgaaggaaagaacacagtggcttttgccagcaaacctaaacaaaaccagagtaatctggaaaaggtaacttgtgcccatgaaaaaagtgacatcgttcataataaattccaaaacaactttcctgctaaggccattgaacacaaaatcaatgtgatacttttaggcccgagcgggcgggaagggatctctctaggagctgacactcgaaccttcacgacccattcggatttttccaggactcaggagtggcactgggaagaaggggaccgctttctgcaattggcctcgacactggctgccaagaagacctgtcgcctttgtttttaagtctccagaaatggaagaagaaggcgaagtcagttgaagtcacgagaaatcagcgaggcatttgaaggcgcttcctgaaaacctttattccctggcacgttgtctgtttcaacagccctgcccctcctcggagcctgcttgtggaattcttccccttcgggtgtgtggtggcattccccgccacgtccaatgtggactccaaaggatttgtcccttctttgtcatttgaaatgaaatgatggccacgcgtcggactggtctgtctgagggagatagtgacaagctcaaggcgtgcgaggtctctcaaaataaagatgtgggagaacaaagttgttacagtgtcactagtctgcagaaggggacaatacttctccgggaggaggtcccaacaaaagtttttgttttaaaagaactcctcagggtttgggttttcaataaaagcattttgttggttatcccccggagtcttggaattcaatttttccattaggggtgaaaaaaatgtaacacggggggggaaacaaagaaaccgtttgaacccatgggaacc

SEQ ID NO: 385 - DNA, 975 bp, Homo sapiens
  CDS (259)..(855)
acatgcatgcattgtattagtgttagaaaacacagctgcgtaaataaacagcacgggtgacccgcattcccgctcggacactcgcgcgcagccccgcggccgtccctcctcgctgcggcccgcggtgtcctcggggtgcgagctgcacgtggacgcagggccccctcaggccgccagggggcggcatagcgcagcgcgcccccgacccggaagacggaagcccaagaacgccgcttccgcccggcgcccacttccaagatggcggcggggcggggccggggcagggccggggcagggcggacggagccggcgagcgggatgctgcggactgcgctgcgcggcgcgccgaggttgctgagtcgcgtgcagccccgggcgccctgcctgaggcggctgtggggccgcggggcccgtccagaggtcgcggggaggcggcgggcctgggcctggggctggcggcgctcaagctccgagcaggggccggggcccgcggcggctctggggcgcgtggaggcggcgcactaccagctcgtctacacctgcaaggtctgcgggactaggtcctccaagcgcatctccaagctggcctatcaccaaggcgtggtcattgtgacctgccccggctgccagaaccaccatatcatcgctgacaacctgggctggttctcggacctgaatgggaagagaaatatcgaagagatcctgacggccagaggcgagcaggtgcaccgtgtggcgggcgagggggccctggaactggttctggaggctgcaggggcccccacatccactgcagctccggaagcgggtgaggatgagggtccccccagccctggcaagacggagccgagctgactcctgcgctccccggcactgtgggacttcggccttccagaaggaggttttggccctgggcctctctggacgtggcctgttttctatcaataaacagacattacttccaaaaaaaaaaaa

SEQ ID NO: 386 - DNA, 1035 bp, Homo sapiens
  CDS (423)..(989)
tagatctgacgcccctccccccatacactagttttctagttactcctgtaggtggcggagcgggcaggaaggcgctttcgcaattgaaccgtctgcatgcccgagggttgggtggtttcggcctcctcttctgttccccctcgtgtctctcctcccaccttgtccccactcccgctagcccgctgcctgccgagggtataagactcccccctcccttgatttatctggttacgtgtaatcgaggcgtgttttacgcgcatctctttgcaagtgggaagtcggcactggagcacacaacagtggcatgggtcgagggtgtcccagggcccctcgcggttctccctcctttcctcccggcctgctccccttcccattgcccctgacacctgcacttcctggtctccccgcagggtggcggcggcatggaggcgcgcttcacgcgcgggaagtcggcgctgctggagcgcgcgctggcgcggccgcgcaccgaggtgagcctgagcgccttcgcactgctgttctccgagctggtacagcactgccagagccgcgtcttctccgtggccgagctgcagtcgcgcctggccgcgctgggccgccaggtgggcgcgcgcgtgctggatgcgctggtggcgcgcgaaaagggtgcccggcgtgagaccaaggtgctaggcgcgttgctcttcgtcaagggcgccgtgtggaaggcgctcttcggcaaggaggcggacaagctggagcaggccaacgatgacgcgcgcaccttctacatcatcgagcgcgagccgctcatcaacacctacatctccgtgcccaaggagaacagcacgctcaactgcgccagcttcacggcgggcatcgtggaggcggtgctcacacacagcggcttccctgccaaggtcacggcgcactggcacaagggcaccacgctcatgatcaagttcgaggaggcagtcatcgctcgagaccgggccctggagggccgctgaccctgccggagataaaggatacagagagcccctcaaaaaaaaaaaa

SEQ ID NO: 387 - DNA, 1111 bp, Homo sapiens
  CDS (76)..(1089)
ggctcgcgctcgagctgcggcgccggctcctgccgcctgggccccgggcccggcccctcccgcgccgcccgggcgatgagaagctgcttctgcgtgagacggagccgggacccgccgccgccgcagccaccgccgccgccgccccagcggggaacagaccagtccaccatgcctgaagtcaaagacctctcagaagccttgccagaaacgtcaatggatcccatcacgggagtcggggtggtggcttctcggaaccgagccccgacaggctatgacgtagttgcacagacagcagatggtgtggatgctgacctctggaaagacggcttatttaaatccaaggttaccagatacctgtgtttcacaagatcattttccaaagaaaatagtcatctggggaacgtgttagtagatatgaagctcattgacatcaaggacacactgcctgtgggcttcatcccaattcaggagacggtggacacacaggaagtggcttttaggaagaagaggctgtgcattaaatttattccacgggattcaacggaagctgcgatttgtgacattcggatcatgggccggaccaagcaggccccgcctcagtacacgtttattggggaactgaacagcatggggatctggtatcgaatgggcagagtaccaagaaatcatgactcatctcaacccacaacgccttcccagtcatcagctgcctccaccccagcccccaaccttcccaggcacatctccctaacacttcctgccaccttccgaggcaggaacagcacccggacggactacgagtaccagcactccaatttgtatgccatatcagctcttcccagaagccctccctggcagctcctgtcctcctctgctggatcctgtgagcaccacagcctcctgtacaccctgagctatgcctctcaaggccctccaccagctcatcccctgctgtgggcacaagccctgctttcagagtttccctgcccagggaatgaatgccccttgagagaccacacatatgctgcaagtccagccctgctcagagccgttctttgccaaataatcaccttgttattaaagagctgattgttctactaaaaaaaaaaaa

SEQ ID NO: 388 - DNA, 946 bp, Homo sapiens
  CDS (63)..(752)
cgtaatctctcagcctttctgtgtctcctttcctccgcctcagtttggggcgggtcgggggaatggctgaggagatggagtcgtcgctcgaggcaagcttttcgtccagcggggcagtgtcaggggcctcagggtttttgcctcctgcccgctcccgcatcttcaagataatcgtgatcggcgactccaatgtgggcaagacatgcctgacctaccgcttctgcgctggccgcttccccgaccgcaccgaggccacgataggggtggatttccgagaacgagcggtggagattgatggggagcgcatcaagatccagctatgggacacagcaggacaagaacgattcagaaagagcatggttcagcactactacagaaatgtacatgctgttgtcttcgtgtatgatatgaccaacatggctagttttcatagcctaccatcttggatagaagaatgcaaacaacatttgctagccaatgatataccacggattcttgttggaaataaatgtgacttgagaagtgccatacaggtacccacagacttggcacaaaaatttgctgacacacacagtatgcctttgtttgaaacgtctgctaaaaaccccaatgataatgaccatgtggaagctatatttatgaccttggctcataagcttaagagccacaaaccattaatgcttagtcagccccctgataatggaattatcctgaagcctgaaccaaagcctgcaatgacgtgctggtgctaaataacagtctttattatattatctaattttgactaaagaaatacttttgaagtatgacagtattaagtcataagatttaatctcaactataatgggtcatcttgacactttgctgtttgtcattgtcacgcttttgtattttgtatctacttaagtttgtcactggaacagcacaggaaaagttgcaacaaatt

SEQ ID NO: 389 - DNA, 2584 bp, Homo sapiens
  CDS (272)..(2191)
tttcgttggagaagcaaggaggcgattggcgctggtgaatgccaatgcccccgccgggcggctgagggggcggagcctcagccgctgtggatggggagtggaggcggaggggagcggagcccggagcgtcgtggaaagcattggacacatttccaccatgctaatggcattttaaatatatttggcaattttcccaattttttactgaagaaaactgtaagtttatacttgaggactgaagtgtgactctgccgattatcaggctttcaagatgaatctggaaaaactcagcaagcctgaactcctgacactatttagtattcttgaaggagagcttgaagcaagggaccttgttatagaagccttaaaggcccaacacagagatactttcattgaagaacgctatggaaaatataacatcagtgatcctttaatggctctacagagagattttgaaacactgaaggagaaaaatgatggcgaaaagcagccagtctgcacaaatccactctctattcttaaggttgtgatgaagcagtgcaagaacatgcaggagcgcatgctgtcccagctggctgctgctgagagcaggcaccgaaaggtgatcctagaccttgaggaagaaaggcagcggcatgcacaggatacggctgaaggagatgatgtcacctacatgctagagaaggaaagagagaggctgactcaacagttggaatttgaaaaatcccaagtgaaaaagtttgaaaaagaacagaagaagctctctagtcagctggaagaggagcgctcccgccacaagcagctctcatccatgctagtgcttgagtgcaagaaagccaccaacaaggcagccgaggaaggacagaaggcaggagagctgagcctgaaattggagaaggagaagagccgggtgagtaaactggaagaagagttggcagctgagagaaagagaggcttgcagactgaggcccaggtagagaagcagttatcagagtttgacatcgaaagggaacaactgagagcaaaactgaaccgagaagagaaccggaccaaaaccctgaaagaagaaatggaaagtttaaagaagatagtgaaggacctagaggcttcccaccagcacagtagccctaatgagcaattgaagaaaccagtaaccgtgtccaaaggcacagcaactgagcctctcatgctaatgtctgtgttttgccaaacagagagttttccagcagaaagaacccatgggagcaacatagccaagatgacaaacactgggctgcctggtcctgccactcctgcttactcatatgcaaaaaccaatggccattgtgacccagagatacaaactaccagggagctgactgcaggcaacaatgtagaaaaccaagtgcctccacgggaaaaatctgtggcattggcccaagagaaaccagtggagaatggtgggtgtcctgtggggattgagactccagtcccaatgcccagtcccctctcttccagtgggagctcactgtctcccagcagcactgcctcctcctctctaacatcctctccttgctcttcgccggtactcactaagcgtttattggggtcatcagctagcagccctggctaccagtcatcgtaccaagtagggatcaaccaacggttccatgcagctcgccacaaatttcagtcccaagcagatcaggaccaacaagccagtggcctacagagccctccatccagggatttatcccccaccctcatagacaactctgccgccaagcagctggcccgaaacacagtcactcaggtgctctccagattcactagccaacaagggccaatcaagccagtctctcccaacagctctccctttggcacagactatcgaaatctagccaacactgccaatccaagaggtgacacaagccattcacctactccagggaaagtgtccagtcccctgagccccctgtctccaggaatcaagtccccaaccatccccagagctgagagaggaaaccctccacccatcccacccaagaaacctggcctcaccccttctccatctgctaccactccattgaccaaaactcattcccaggcagcctctttgaccactgcagaagaccttgccagcagctgctcttccaatactgttgtagcaaatggtaaggatgttgagttacttttgcctaccagcagctagtccctaggagggagtctccacgtttgacattccatcagatttcgtccaaaagctcagtcagacttctgagtcagattatgttatttattttgatagtagctgaaaccatctgtataatacatttagtatatttcaccattttgtatttttttaagtagaaactgagtagtttggatttttatggctcacatctttttactgaagccagaaaggcacctcaaagatgtctcaagctcagcagtcaccgtcatgttgtgatgaaaaaagcgaatcaccaggtggtgatttgctatctatttgagaactagaatcactcaacactcattttgaattatgcaagaagggttcatgcagattttttttccagatgaacatgttttaaaaatgcctgaa

SEQ ID NO: 390 - DNA, 733 bp, Homo sapiens
  CDS (111)..(329)
gggtctgagtgcattcaataaatcctcctccttttaccccgtggtctttctggttctcctgattctgcaaccgttgtgtcttccatgtaaaattctgagactccagcaggatgtcttatcaacagcagcagtgcaagcagccctgccagccacctcctgtgtgccccgcgccaaagtgcccagagccatgtccacccccgaagtgccctgagccctgcccaccatcaaagtgtccacagtcctgcccacctcagcagtgccagcagaaatgtcctcctgtgacaccttccccaccctgccagccaaagtgtccacccaagagcaagtaacagcttcaggattcatcaggagcatgaaaggataaggataattggctcacctcgttccacagctccacctgcatcttctcatcaaagccatccagggatacacagggagcttctttcctcttagcctgtgatcggcctgtgatgatctctgatagcaaaaggttttctttttgaggctgccatactgccactgtccaggtggagactgagcaaaggaagtcctgggctgtgccagctcccagagcttcagaagaaagagcagctctctccctgggaaccattagagaattctgttgatgttttctgtgtctgtctgtcccctgggcatgagcttccaccacctgtgcagttgtcactttcctttcactccctgaataaagaatctatgcataaaaaaaaaaaaa

SEQ ID NO: 391 - DNA, 1392 bp, Homo sapiens
  CDS (190)..(1020)
ccgccggcgccgcggggaggtggtggaggcctagccggagccgagaggtctcttgttcccgtcccacggtcccggcgtcacccctccggcgcccagtccccgtcccggaactcccgggcctgtcctgggcccccggtctgtgcactccgctcgccgcagcgcccggcccgggccgcacccgccggccccatgaggagggacgtgaacggagtgaccaagagcaggtttgagatgttctcaaatagtgatgaagctgtaatcaataaaaaacttcccaaagaactcctgttacggatattttcttttctagatgttgttaccctgtgccgctgtgctcaggtctccagggcctggaatgttctggctctggatggcagtaactggcagcgaattgacctatttgatttccagagggatattgagggccgagtagtggagaatatttcaaaacgatgtgggggctttttacgaaagttaagtcttcgtggatgtcttggagtgggagacaatgcattaagaacctttgcacaaaactgcaggaacattgaagtactgaatctaaatgggtgtacaaagacaacagacgctacatgtactagccttagcaagttctgttccaaactcaggcaccttgacttggcttcctgtacatcaataacaaacatgtctctaaaagctctgagtgagggatgtccactgttggagcagttgaacatttcctggtgtgaccaagtaaccaaggatggcattcaagcactagtgaggggctgtgggggtctcaaggccttattcttaaaaggctgcacgcagctagaagatgaagctctcaagtacataggtgcacactgccctgaactggtgactttgaacttgcagacttgcttgcaaatcacagatgaaggtctcattactatatgcagagggtgccataagttacaatccctttgtgcctctggctgctccaacatcacagatgccatcctgaatgctctaggtcagaactgcccacggcttaggtaaacatttcttgtttagctcaaaaaaatcatagaacaaaagtttccttcacccatatttcttccttggaactttggaattttaaggtaggcactgcagacgctttgaaattttaaggtagtcccttttagatgcccacctacttcctttttgtacctcatttgatttcatgtaattggtgtgaaccaaggggtaacaatccccaaattccactacttgctatccatactagaaaaaagaatcaacattttattacttgagatagaaagaaaggtattttctcttattaatgcttttgtataattcttttctcaaagtagtttttaaaggtccaccctaaggtcatttgtcatagtaatgataccaggtacatag

SEQ ID NO: 392 - DNA, 4162 bp, Homo sapiens
  CDS (386)..(877)
ggatggagaggctggtggaaggagaaatcagccgacccccttgggtcatctccagttgcaagatggcgtggcccttgcccagggtgctgccctccctgttggaatccagggcatggggctatggcccgaccaccaaatctggctgcagcttggatggatagcttatcttcctttgcaggtttctaggggagagtttaaccaggtatcaggaaggactttacggcaggaagagcagctgggtgggaaagggattcaggggaacattggtgaaagaagccacagtcctggcaagacgagggacttgagccctcctggagcccccaacctggctgactgtcctgctcttttcctgcccactccaggctggcctgccactcctcctgctatgatgcctgggcagatcccggacccttcggtgaccacaggctccctgccagggcttggccccctgaccgggctccccagctcggccctgactgtggaggagctgaaatacgctgacatccgcaacctcggggccatgattgcacccttgcacttcctggaggtgaaactgggcaagaggccccagcccgtgaaaagtgagctagatgaggaagaggagcgaaggaaaaggcgccgggagaagaacaaagtcgcagcagcccgatgccggaacaagaagaaggagcgcacggagtttctgcagcgggaatccgagcggctggaactcatgaacgcagagctgaagacccagattgaggagctgaagcaggagcggcagcagctcatcctgatgctgaaccgacaccgccccacctgcatcgtccggaccgacagtgtcaagacccccgagtcagaaggcaacccactgctcgagcagctcgagaagaagtgaccatgggctgggaggaggtggaggaggaggaagaggagaaggaaaagtgacgaagagagaggaggaggggggccccagatggcccttcctttggtgcatgaaaaactgtacaatgaggttcagcacagccagcatcagccgagcttttttgtgaaactcagatcagccacccaggaggaagagcgggctgaggaaacccagagggaccaagcgctgagaccaaagttgaccctcgggtagggttgtcctgcctggggccccacttgaaggaggcaggacagaggcaccgaggccagggagacgcccaacgaggcagccctgggctcttctctggcctcttcaccagggcacccatccaaggaacctccgaacagccaggaaaagccatgagttgcaaccaaaacgcggctgaggatggaactcagaatgaaactgcaacccacctgcccccagccctgcccctcgccctgatgcgaagctggagaggggcgtgctgcggggccctgatgcccccacccacctcggtccagcgcggccctgcccaggaggcggcagccgggcgcaccctcgccagccctgctggagtttgctgtgggcactgaggcgcgggcgcccttccaaagcacatactcaccgaatgtttacagactggctgtcctggcagggctttcaactgcacatgttttttatactttcctttttttttttttttttaatattttttacaaaaaaaaagattttatacaagcaatatatatatggatttctataatcactcgatgtgatacagtataaatatgctatggtttgtttgttatgaacagatagccaccagttacggccgttgtgtgtaactcctaagtactgtagtctctgggtgtcgggggtggccagggcgggggcggggtgcatttccatccttgtaaacccttcatagtactcagtcctgtatcgctcagtaaacattgctcttacttaaaaaatttttttttttttttttattttagatacagcctttatttttttttccacgggaagttaaaaatccatcataagactccataagactttactagtcttgcatgtagactctaggagtttgtgatctgataaaagagtaacatgaaaatttactgtattgccctaatttcatacttccttgtacacaatgaatcactctgagaatctattccaagggttatatacacaaaagtgtcaagaataaaatgttctccactctcgcataaaaatgtgtacagtgtatcaggaatggaaaacttctaattttcctgggcccgggcttcatggatttctgctgccagaagatgaaagactccttctgctttattgctccattgttctgaggattaatcatccaaccctggcgtttctccttgttggattctagacgctattctgatggcttcttccagagatggctgttctccaagctgaactgcaatctgggtgccattggatgttgctactaaggtcagaggtctggtttctgtggttactaagtgatggctatgctgctggtgccccatttctgatgaggcagtatggaatgctgccaagtcttgagctacaattgcaacctgttccccttctgtaccctcagcagtaaccatagcaacagagtgcgttcctgctgaggagatgactgcatcatgggcggggactgtgatgggcgtgccatcctgcgttaccattgtgatggtgttgccaatggcctgcatgtcagcttgagatatgttgacatgctgagtcccatcctgggatatgagtgtaacttgttgactcagtccagattgggttactgtggctacttgtgtagaaacaacgtcgtccccttctacacctgtaacatacgtaatctgggaccctttaagaacatcttcaccttgacctgggggcggctcaaagaaggcttcctgctcctcctcgatgggctcagtgtcgttgtgggctgtccgtttgtgcatggccagcgtggagatctgcttgtatgtcttcccacagtggttacagttgtaaggtttggaatgagtgtggacaacatgatgtttgtacaaactggaatattctgtaaaccttttgtcacacccaggaactgtacaaacatatggcttttctcctgtgtgtatcctcacatggtttttataatttgttgcactggcaaatgccctcccacatcctggctctgtgcagtaataaggtctttctcctgtgtgtgtcctaacgtgcacttttctgatatttgatgttgtaaaggaccgaccgcagccttcgaagggacacttaaagggcctttctcctgtatgagttctgatgtgtttctgtagatctcctgaagttttgaaagatttagtacaattatcttccgaacaccgatatggcttttctcctgtatgagttctgacgtgactttttaatccataacctgttgcaaatgccttcccacagcctgcatgctcacactgataaggccgatctcctgtgtgtgacctctcatggaccttgagatgatgagctgttgtatataattttccacatccatcatattcacatcgaaatgccttctctccactctgttgagatttagcagttactcttgtagcatgtccttgtaaaacaatctgcatttttttctcttgctcattttctccaatcattccagtacctgctacactttcacttccatcaatggacacctttgctgcatactgttccaaagcactgatggtgtcagggtcaattgtagcatccccagtgtgcagacctgccactgtcccatcagcctgaattgccaagatggtgtcagactgcgggacttgcactgcatggtggatataagctgtggtaccatcttccagctgaaccgcctgtaatgcactctggtcataactatctttggaggtgtggtgaataaatgctgtggtaccatcttctaactgtactgcttgaccatcctctagacgcaaactgtcccctgtacttttaggtatgggtacatgttgaacataggccgcagaaccatcttccaactgaatgacctggccatctatgagttttgcatctttagaattgtgttgtatgtaagcagtagaaccatctgcaagtgttactgcttgcaagcttacgccttccatattttctaagttgtcaccatctgccacggtgactgcctctgtcaagcacagcgtaacatgttgcgcctccatccctcctccaggaaactctgtcattccctgagaatctcgatttatttgggctaacctttag

SEQ ID NO: 393 - DNA, 1006 bp, Homo sapiens
  CDS (111)..(833)
aggtctaatgtgcggctggcggtggaggtgcgaatcagccgcgagctgcgagagaagctggctgagctggggcccgtgcggggagacgccgaggggggcgcatccccaccatgggctgcctggacctgcccggagaggatatgaggaagacatggagacgatttgaagtcccaacatccaagtcatctaattcagaggatgatctccctgaagattatccagtggtcaaaaaaatgcttcatagactgacagccgacctgaccctggaccctgggaccgcacaccgccgcctgctcatctccgccgaccgccgcagcgtacaactggccccaccagggacgcccgcgccccctgacggccccaagcgcttcgatcagctcccagctgtgctgggtgcgcagggcttcggggccggccgccactgctgggaggtggagactgcggacgccgcctcctgcagagactcttctggggaggatgcggacgacgaggagagccactatgcagtgggcgcggccggggaatcagtgcaacgcaagggctgcgtaaggctgtgccctgcgggggccgtgtgggccgtggagggccgcggcggccgcctgtgggccctcacggcacccgaacccaccctgctgggcggtgttgagcccccgccgcggcgcattcgcgtggacctggactgggagcggggccgcgtggccttctacgacggccgctcactcgacctgctttacgccttccaggcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggggtggaattccccactcatttctgggaacacattcacacgcccattgcaggagtattaatagcaacccacattttcgccccaaaataatgagacctcacctggtctccacgtttcc

SEQ ID NO: 394 - DNA, 1889 bp, Homo sapiens
  CDS (340)..(897)
gctggggggcttagaattttatttttggtttacagcgcagaagaagagcagtgaggccggggcgcgggtggggagggcaaggcggcggctcaaaaaaaaagccagcccctcgcggcccgacagagtctcggcgccccgcgggtcggtggagcctcatgggtgagcgcaggccggagacaggggaacccgccgcgggacaggggaaggccggacggaacgcgggtaagctgccgcagcttccggccgggccactagcgcggaccctacggccggggcgggacttccggcaaggcgcggaagcggcggtagctgcagctggcgaagttgggcgactggcggatgcaggccttgcggcacgtcgtgtgcgccctgtccggcggcgtggacagcgccgtggccgcgctgctgctgaggcggagaggttaccaggtgacaggggtgtttatgaagaactgggactcactggatgaacatggggtctgtactgccgacaaagactgtgaagatgcttacagagtttgccagatcttagacatccctttccatcaagtgtcctacgtaaaggagtattggaatgatgtgttcagtgactttttgaatgagtatgaaaaaggaaggactcccaatcctgacatagtttgcaacaagcacatcaaatttagttgcttttttcattatgctgtggataatcttggggcagatgccattgccacaggtcactatgcaagaacttccctggaagatgaagaagtctttgagcagaagcacgttaagaagcccgaagggcttttcagaaatcggtttgaagttagaaatggtttcccaggatgccctgaggagaaccatcttccctctggggggattaacgaaagagtttgtaaagaaaatcgctgctgagaatagacttcatcatgtgcttcagaagaaagagagcatgggcatgtgtttcatcgggaagaggaattttgaacatttccttcttcagtatctgcagcctcgacctggtcactttatttccatagaagacaataaggttctgggaacacataaaggttggttcctgtataccttgggccagagagcaaacataggtggcctgagagagccctggtacgtggtggagaaggacagcgtcaagggtgacgtgtttgtggccccccggacagaccacccagccctgtacagggacctgctgaggaccagccgcgtgcactggattgcggaggagcctcccgcagcactggtccgggacaagatgatggagtgccacttccgattccgccaccagatggcactagtgccctgtgtgctgaccctcaatcaagatggcaccgtgtgggtgacagctgtgcaggctgtgcgtgcccttgccacaggacagtttgctgtgttctacaagggggacgagtgcctgggcagcgggaagatcctgcggctggggccgtctgcctacacgctccagaagggccagcgcagagctgggatggccactgagagccccagtgacagcccagaagatggtccaggcctgagtcccttgctctgacagagatggatctgctagaaggaacctggagagcaggacccatggctgggcggctggtgagcagtccaggtgcccaagggccagcttgctgctgcccaaagcagaggaagccgggctggctgagggtccgaaaagcctgcaggggcccggcgagccccaggaagagcctcagctccaggctggggctctggctgctggagcatctgctggctggtggggtggcccgagttccccttcaccgcccccagggagggtttcccacctcagagtacaccgaggggacctgcagagggggctgtcgggacagcgtggaataaacattatttcaaggacaaaaaaaaaa

SEQ ID NO: 395 - DNA, 2612 bp, Homo sapiens
  CDS (1067)..(1867)
atggtttcagagaaaggattcagtgctcctgtaggaccttggggcttgctgccccaagtttctgctccctgcattccagcacagtgctccttgaccatgccagctgtggctcaaataagcccaggtacagcttcgtctgctgctctagaaggcacaagtggtaatccttggcagtgtccacctgacgctaactctgcaggcatgcagaatacacaagctaaggaggcatggctgcctctacctaaattgcaaaagatgcctcagagagccttgggacccaggcatagaactaccacagagtcagggccaccacagagaatgatcactagggtaatgcctagcagagtcatggggctggggccaccacagaaagtctccactaagtcaatgcttagtgaagccatgggagcagggccatttccatggccccagaactatagagccaccaacaattccatgaagcattacagtggaagccgttcatcttcagagcttcaagaaagggtcctaaaagccagagtggttgaatggttgatgaaggtttttagaggaggaccccagctcatcactgaggaagagggaaatgcagccagcggtttggcaaactgccctccccaaatacccctgttccagccttcacagtggtttcctgagcagctcgaggcgggccagaaagccaggatttgggatccgaagcaggacgtgcagacctacgaggggctgcggacggaggcaccggagggcacttctcacctccgggtgtgccgggaggggcacgcggaccgagcttgcaaatgcaggatgggacccagcgagggagccgcgagcgaggctcaccgtccccggcgtgcaggatccggggctgctgagcgctcgctcccgcgtgtccggcgcttggagtccccgcggcaggagaggagtcgggacactagagctccaggggcgcctgtgggctccagggcctccggcttccccagtccccttcagctaaagccccagagacgtgctcagccccaggacctctgcggaacaagatccggattgagaagccactgcaactaccgaaatgggcagcaaaaccttgccggcgccggtgcctatccacccttccctgcagctcaccaactactccttccttcaggcagtgaacggcctgcccacagtgccttcggaccatctgcccaacctgtatggtttcagcgcgttgcacgctgtgcacctgcatcagtggacgctgggctacccggccatgcacttgccgcgctcttctttctccaaagtgccgggcacggtgtccagcttggtggatgcgcgcttccagctgcccgcctttccctggttccctcatgtcattcaacccaagcccgagatcaccgctggaggcagcgttccagcgctcaagaccaagccgcgctttgattttgccaacctggccttggcagcaacgcaagaagatccggccaagctcggtcgcggggagggcccaggctcccctgcaggtgggctgggtgccctcctcgacgtgaccaagctgtctccagaaaagaagcccacaaggggacgtctgccttccaagaccaagaaggaattcgtctgcaagttctgtggccgccacttcaccaagtcctacaacctacttatccatgagcggacgcacaccgacgagcggccctacacctgtgacatctgccacaaagccttccggaggcaagaccacctgcgagaccacagatatattcactccaaagagaagcccttcaagtgtcaagagtgtgggaaaggattctgccagtccaggactctcgctgtccacaagacgctacactcacaggtgaaggagctcaaaacctccaagatcaaatgctaaatagaacctgtgggtcacaaggaccctaggcccagcggccctctcctccatagggaccagaagcctgactctggcgggcagcgggagaggcgctcgctcgggaccttccacctctccaacattgtcccctgggtccctggcgcacgcggcacttcagagccccgcccggggccgcgaccccgaccgtccctgctgctcccctaggacgcggctaaactcttggccaaaaggcggtactcacgtggcggaagggaaactgcattaaaaaaagaacgaaagctccgcggagccgcagcggcgcctctcccagaagtattactttttctattgttattttatacgttttcttttttatttttgtctttgaccatataagcttgtaactctgactgcggagagtgagtggagagaggagaggcaacgaagtccttagcactggcagctcccacctcctcctcccgcccctgcccccacccccggagcctgcaaaagtgtaatccctgtatctgcttcagcctcctgccctagggaccgcggggcagccccctcccagctcttgcagctcagctggcggccgtgggctccgggactaggagagcgggacggggacctcgggcctggggtctgcagggggcccggcctccgctgccgcgacactgcgagggagcagccagccaagagccgggcgttatattgcgattggcactttatgctgaccatcggtaacggacatttatcactggag

SEQ ID NO: 396 - DNA, 2889 bp, Homo sapiens
  CDS (319)..(2889)
ggtggaattcgccatttgtcactggtggctaccatatgaaacagttcaggtgtagactcctttactatttcaactcaaagtctttcggtgaatcatgccctttattccaatgagtattacagatattagaagttcagggcctcgagtcattgacatttgtattcatgttgtgtcttcgtcactagcagtagtgattttaagtgtcgtgctatgatagctccatgcatgtaaagataaaagccccaaacactatcagctgttcattcagctcgtggaaattctaattccgtgttcattttttttctatagacatttgccatggctgagcacttcaaacagatcattagatgtcctgtctgtctaaaagatcttgaagaagccgtgcaactgaaatgtggatatgcctgctgcctccagtgcctcaattcactccagaaggagcccgatggggaaggtttactgtgccgtttctgctctgtggtctctcagaaggatgacatcaagcccaagtacaagctgagggcgctggtttccatcatcaaggaactagagcccaagctgaaatctgttctaacaatgaacccaaggatgaggaagtttcaagtggatatgacgttcgatgtggacacagccaacaactatctcatcatttctgaagacctgaggagtttccgaagtggggatttgagccagaataggaaggagcaagctgagaggttcgacactgccctgtgcgtcctgggcacccctcgcttcacttccggccgccattactgggaggtggacgtgggcaccagccaagtgtgggatgtgggcgtgtgcaaggaatctgtgaaccgacaggggaagattgtgctttcttcagaacacggcttcttgactgtgggttgcagagaaggaaaggtctttgctgccagcactgtgcctatgactcctctctgggtgagtccccagttgcacagagtggggattttcctggatgtaggtatgaggtccattgccttttacaatgttagtgatgggtgccatatctacacattcatcgagattcctgtttgcgagccctggcgtccattttttgctcataaacgtggaagtcaagatgatcagagcatcctgagtatctgttctgtgatcaatccatccactgccagtgccccagtttcttctgagggaaactggggtggctgcgccctggccttatgcaaggccattgccttgtccgtgtcctctgcaggtctgtgggttctggcaccacctgagcccactgggcatctggtcatccctggcacctctcctttggagccaccttgtccctggctagacagtcacattttccagtgccgttttggaaagatgttgcctttggagaaggcgtttgcctcccccaggagctccccagccccgccggatctgcccacgccggggtcagcagccggagtccagcaggaagaacccgagaccatccctgagaggacccctgctgacctggagttctcccgcctgcgtttccgggaatttgtctaccaggaggctgccgggccccaccagaccctggcccggctgcatgagctgtgccgccagtggctgatgcctgaggcgcgctccaaggagcagatgctggagctgctggtgctggagcagttcctgggcatcctgcctgataaggtccggccctgggtggtggcacagtaccctgagagctgcaagaaggcagcctccctggtggagggcctcgctgatgtcctggaagagccagggatgctgctgggctcccctgcgggctcatcctcaattcttagcgatggagtgtacgagaggcacatggaccctctgctgctaccaggcgagctcgcgagccccagccaggcccttggagctggggagatcccggcaccttctgagacaccctggctttctccggaccccctgtttctggaacagaggagggtcagagaagcaaagaccgaagaggacggccctgccaacaccgagcagaagctgaagtcctttccagaggaccctcagcacctgggggagtggggccacctggaccctgccgaggagaacctgaagagctaccggaagctgctcctgtgggggtatcagctttcccagcctgacgctgcctccaggctggacactgaggaactccggttggtggaaagagatccacaaggaagcagcctcccagaaggcgggaggcggcaggagagcgctgggtgcgcctgcgaggaggccgcccccgcgggggtgctgcctgagctgcctacggaggcgccccctggggacgcccttgccgatcccccgtcgggcaccactgaggaggaggaagagcagcctgggaaggccccggacccgcaggacccccaggacgcggagtccgactctgccaccggatcgcagaggcagtccgtcatccagcagcctgccccggacaggggcacggcgaaactgggaaccaagaggccgcaccccgaggatggtgacgagcagagcctcgagggcgtctctagctccagcgacagcgcagggctggaggccgggcagggccctggggctgacgagccgggcttgtcccgcgggaagccctatgcctgcggcgagtgcggggaggccttcgcgtggctctcgcacctgatggagcaccacagcagccatggcggccggaagcgctacgcctgtcagggctgctggaagaccttccacttcagcctggccctagccgagcaccagaagacccacgagaaggagaaaagctacgcgctggggggcgcccggggcccccaaccgtccacccgcgaagcccaggcgggggctagggcgggcggtcccccagagagcgtggagggcgaggctccccccgcacccccagaggcgcagaggtga

SEQ ID NO: 397 - DNA, 1974 bp, Homo sapiens
  CDS (55)..(1824)
aaaggtctctgaggcggcggcggcggcggggatcgtctccggcactggcgcaccatgtcggtcagtgtccatgagacccgcaagtcgcggagcagcacggggtccatgaacgtcaccctcttccacaaggcctcccacccggactgtgtgctggcccacctcaacacgcttcgcaagcactgcatgttcaccgacgtcacactctgggcgggcgaccgtgccttcccctgtcaccgtgccgtgctggccgcctctagccgctattttgaggccatgttcagccatggccttcgggagagccgggatgacactgtcaacttccaggacaacctgcacccggaggtgctggagctgctgctggactttgcctactcctcacgcatcgccatcaacgaggagaacgctgagtcactgctggaggcaggcgacatgctgcagttccacgatgtgcgggatgctgccgccgagttcctggagaagaaccttttcccctccaactgcctgggcatgatgctgctctcggacgcccaccagtgccgccggctgtatgagttctcctggcgcatgtgcctggtgcactttgagacggtgaggcagagcgaggacttcaacagcctgtccaaggacacactgctggacctcatctcgagtgatgagctggagaccgaggacgagcgggtggtcttcgaggccatcctccagtgggtgaagcacgacctggagccacggaaggtccacttgcccgagctcctccgcagcgtgcgtctggccttgctgccgtccgactgcctgcaggaggccgtctccagcgaggccctcctcatggcagacgagcgcaccaagcttatcatggatgaggccctgcgctgcaagaccaggatcctgcagaatgatggcgtggtcaccagcccctgtgcccggccacgcaaggcgggccacacgctactcatcctggggggccagaccttcatgtgtgacaagatctaccaggtggaccacaaggccaaggagatcatccccaaggccgacctgcccagcccccggaaggagttcagcgcctcagcgatcggctgcaaggtctatgtgacggggggcaggggctccgagaacggggtctccaaggatgtctgggtgtacgacaccgtacatgaggaatggtccaaggcggcgcccatgctgattgcccgctttggccatggctcagctgagctggagaactgcctctatgtggtggggggacacacatccctggcaggggtcttcccggcctcgccttctgtctccctgaaacaagtggagaaatacgaccctggggccaacaagtggatgatggtggcccccttgcgggatggcgtcagcaatgccgcagtggtgagtgccaagctgaagctctttgttttcggaggaaccagcatccaccgggacatggtgtccaaggtccagtgctatgacccctcggagaacaggtggacgatcaaggccgagtgcccccagccttggcggtacacagccgctgccgtcctgggcagccagatcttcatcatgggaggtgacacggaattcacagccgcctcggcctaccgctttgactgtgagaccaaccagtggacgcggattggggacatgactgccaagcgcatgtcctgccatgccctggcttccggcaacaagctctatgtggtcgggggctactttgggacccagaggtgtaagactctggactgctatgaccccacttcagatacatggaactgcatcaccacagtgccctactcacttatccccacggcctttgtcagcacctggaagcacctgcccgcgtgacaccagggccgcatccatctcagtgtggaggacagtgacgggaccctcaccatcctcttgcgttttggcccccatttgctccctgagctccaagataagaatggccccgagagaactgctgaacatttgttcattgctgtcacctcctga

SEQ ID NO: 398 - DNA, 2015 bp, Homo sapiens
  CDS (325)..(1611)
cgcatttggccgaaactcccgggtcgacgattcgtcgtggactcctccccacactgcagcgctcgccgcgcgcgcccatcgatcaggccccctccctctgccgcctcggcgcagactgctaagctcagcaagtcttgcggcaaaggcacttcggagccgagttggggcagcggtggagcggggacttcgcgcccccaggggaacgggcgcccctgcgaaaccgtcgccagccacgcgtccttgccgtccgacgccccctcacattggagaccccggatctctcccgcctccttcgggtcgctctccgctgtttcctctgccaccatgaggaacattttcaagaggaaccaggagcctattgtggctcctgccaccaccaccgccacgatgcccattggacccgtggacaactccactgagagtgggggtgctggggagagccaggaggacatgtttgccaaactgaaggagaagttattcaatgagataaacaagattcccttaccaccctgggcactgatcgccattgctgtggttgctgggctcctgcttctcacctgctgcttctgcatctgcaagaaatgctgctgcaagaagaagaagaacaagaaggagaagggcaaaggcatgaagaatgccatgaacatgaaggacatgaaagggggtcagctcccacaggatgacgacgacgcagagacaggcctgactgagggggaaggtgaaggggaggaggagaaagagccagagaacctgggcaaactgcagttttccctggactatgattttcaggctaatcagcttactgtgggcgttctgcaggctgctgaactgcctgccctggacatgggaggcacctcagacccttatgtcaaggtcttcctccttcctgacaagaagaagaaatatgagaccaaagtccatcggaagacactgaaccctgccttcaatgaaaccttcaccttcaaggtgctgagggctggaagggtgccataccaggagcttgggggcaaaactctggtgatggccatctatgactttgaccgcttctccaaacatgacatcattggagaggtaaaggtgcctatgaacacagtggacctcggccagcccattgaggagtggagagacctgcaaggcggggaaaaggaggagccggagaagctgggcgacatctgcacctccctgcgctatgtgcccacggccgggaagctcactgtctgcatcctggaggctaagaacctcaagaagatggacgtgggcggcctttcagacccgtacgtgaagatccacctgatgcagaatggcaagaggctcaagaagaagaagacaaccgtgaagaagaagaccctgaacccatacttcaacgagtccttcagctttgagatccccttcgagcagattcagaaagtccaggtagtggtcaccgtgctggactatgacaagctgggcaagaacgaagccataggcaagatcttcgtgggcagcaatgccacgggcacagagctgcggcactggtccgacatgctggccaacccccggaggcccatcgcccagtggcactcgctcaagcctgaggaggaggtggatgcactcctgggcaagaacaagtagacagcagcggctgggaccccacacctttcacggacactgacaagatccagagctatcaatacctcagttatgcaaccttagaggttttcttttttctttcatttgttgggtggttgtgtccttgtttttccttgtttttctctttttaaagaccaacttccctttgatggctgtgtgaggagagtcccctaagaggtgaaagagaagcctggctctgttcacggtcccaggagctgtccttgctgcatgccctgtcacagttccctcgactctttcaaagcttcacatctgcctcaccccaagcgaggctctctactggcacaaacttgcagcagttcctgttttttgagccttctggaccaacaaaatggcagcacatcctgcttcccgacagggaaggcatc

SEQ ID NO: 399 - DNA, 2266 bp, Homo sapiens
  CDS (204)..(2156)
tttcgtgggcggcgccacctcgcgctccgccgtggtcccggcgccgggtcccggagacagacgttacgcgggctcgagcgtcctcggggagtgccagccagagttggtgacgaccacttcctcgacgtggggcgggcggacgggaagcctggggtcgtggccaccgcctcgggagctctgggagcccgggtgaccgcgtagaaatgaacacagaagcggagcaacagcttctccatcacgccagaaatggcaatgctgaagaagtaagacaactattagagaccatggcgaggaatgaagtgattgctgacattaattgcaaaggaagaagtaagtctaacttgggctggacacctctacatctggcatgctattttggacacagacaagtggtccaggatctgttgaaggctggtgcagaagtgaatgtgttgaatgacatgggagacacgccgcttcatcgagctgcctttacaggacgaaaggagttggtaatgcttctcttagaatataatgctgatactactattgttaatgggagtggacagacagcaaaagaagttactcatgctgaagaaatcacaagcatgcttgaagctgtagaaaggactcaacaaagaaagcttgaagaattacttttagcagcagcaagagaaggcaaaacaacagaactcacagctctgctcaacaggcccaatcctcctgatgttaactgttcggatcagttaggaaatacacccttgcattgggcagcttaccgggcccataaacaatgggccttaaagcttctaagaagtggagcagaccctaatctgaagaacaaaaatgatcagaaacctcttgaccttgcccagggtgctgaaatgaaacacattcttgttggtaataaggtcatctacaaagcattgaaacgatatgagggccctctctggaagagttcaagattttttggctggagattattctgggtagtgttagagcatggagtcctttcatggtataggaaacagcctgatgcagttcataatatttatcgccagggatgcaaacacctgactcaagcagtatgcacggtaaaatccactgatagctgcctcttctttattaaatgctttgatgacaccattcatggcttccgggttcctaagaatagccttcagcagtcaagagaggactggctggaagcaatagaagaacattctgcttacagcactcactactgttcccaggaccagctgactgatgaggaggaggaagatacggtttccgctgcagacctgaagaaatcattagagaaagcacagtcatgccaacagcgactagatagggaaatttccaactttctcaaaatgattaaggagtgtgacatggctaaagaaatgcttccatcatttcttcagaaagttgaagttgtctcagaagcttctagagaaacttgtgtagctttgactgattgccttaatctcttcaccaaacaagaaggggtgaggaattttaaattggaacaagagcaagaaaaaaacaaaatcttgtcagaagcactggagacgctggccactgaacatcatgaattagagcagtctctggtgaaaggctctccacccgccagcatccttagcgaggacgagttctatgatgcgctgtcagattccgagtccgaaaggtccctgagtagattggaagcagtgacagcacgctcctttgaagaggaaggagagcatttgggcagtagaaaacacagaatgtccgaagaaaaagactgtggtggcggagatgctctctccaatggcatcaagaaacacagaacaagtttgccttctcctatgttttccagaaatgacttcagtatctggagcatcctcagaaaatgtattggaatggaactatccaagatcacgatgccagttatatttaatgagcctctgagcttcctacagcgcctaactgaatacatggagcatacttacctcatccacaaggccagttcactctctgatcctgtggaaaggatgcagtgtgtagctgcgtttgctgtatctgctgttgcttctcagtgggaacggactggaaaacctttcaacccactgctgggagagacttatgaattagtgcgagatgaccttggatttagactcatctccgaacagacacaatgaggcatatacatggacaaatcccacctgctgtgtgcataatatcattgtgggtaaactgtggatcgaacagtatggcaatgtggaaattataaaccacaagactggggaca

SEQ ID NO: 400 - DNA, 885 bp, Homo sapiens
  CDS (218)..(676)
ggggagcggcacagggcagcctcatcagcgtcatgggtggaagtggctgcggctggccgctcaccagaagcgtgtctccctctgcaaggggaaggacaagcccgatgctgagggatccaactctaaacttctcagatactgtgaccatgaggacaagttcctgcttcctctggagaggcagctccacgaggccgcccgccagaacaatgtcggcaggatgcaggagctgattgggaggagggttaacaccagggccagaaaccacgtgggcagggtggccctgcactgggctgcaggtgcaaggcacgagcaggctgtgcgtctgcttgtggagcacgaggctgctgtggacgatgaggatgtggtggggaacactgcccttcatctggctgctggtcggggccatatggctgtgctgcagcgacttgtggacatcgggctggacctggaggagcagaatgcggaaggtctgactgccccgcattcggctgctggaggatcccaccctgactgtgtgcagctcctcctcagggctgggagcaccgtgaatgccctcacccagaaaaacctaagctgccttcactatgcagccctcagtggctcggaggatgtgtctcgggtcctcatccacgcaggaggctgcgccaacgtggttgatcatacaccagaatcctgatgccagcccagtggtcaaactaagaagttttcctgttaccttcatttagtatgttgttttccttttcattttagctgtttttgctgcctatttatttatttatttaattgtgtcacttttatttgttgtatttgctttgtttttaataccaaaagtaacttgttggtagtaacagtgtcaaaagacacattcataaaaagtgaaggcgt

SEQ ID NO: 401 - DNA, 1183 bp, Homo sapiens
  CDS (318)..(962)
tttcgtggttgcgctgggctccgggagcgccgatggcgtgactggccccgcgcggagcagcgacagtaaggctgtgtggggggagctgggacctaagccgcgcgcacacccctttctctgcgtctggtggaggtgcacagaggcttttgagtcaggcccaagcgcagccaggtgacctccccgcggcctttcaagcctgagctcggtggacagctccctctcccgtgagtcccgctgtcctgtacgcgcccggacgagccccgggctgcgcaccccgctaggagctgcccggccagcccgcttctctgcccggagccatgaatctcagtagcgccagtagcacggaggaaaaggcagtgacgaccgtgctctggggctgcgagctcagtcaggagaggcggacttggaccttcagaccccagctggaggggaagcagagctgcaggctgttgcttcatacgatttgcttgggggagaaagccaaagaggagatgcatcgcgtggagatcctgcccccagcaaaccaggaggacaagaagatgcagccggtcaccattgcctcactccaggcctcagtcctccccatggtctccatggtaggagtgcagctttctcccccagttactttccagctccgggctggctcaggacccgtgttcctcagtggccaggaacgttatgaagcatcagacctaacctgggaggaggaggaggaagaagaaggggaggaggaggaagaggaagaggaagatgatgaggatgaggatgcagatatatctctggaggagcaaagccctgtcaaacaagtcaaaaggctggtgccccagaagcaggcgagcgtggctaagaaaaaaaagctggaaaaagaagaagaggaaataagagccagcgttagagacaagagccctgtgaaaaaggccaaagccacagccagagccaagaagccaggattcaagaaatgaggagccacgccttggggggcacggtgcaaagtgggccttccctgggctgtgctgcaggcacagggtgcccctgtccagcccctccacctgtgtctgaatgcaacaggggtgttgcgggggcaacatgagagcccctcacccccaactctccactttcaggaggcccccagtgaagagccccacctcggggtcacaataaagttgcctggtcaggaaaaaaa

SEQ ID NO: 402 - DNA, 889 bp, Homo sapiens
  CDS (152)..(658)
cagtgagctagcttctgagttttcccttctttttatactgttttctgtgctggcttttttgaatcttcctaatttttcatctctttaacaaactcctatgaagttgaaaccgggaagtttgctctaacatttccagagaaggtattaagtcatgatgcaggaatctgcgacagagacaataagcaacagttcaatgaatcaaaatggaatgagcactctaagcagccaattagatgctggcagcagagatggaagatcaagtggtgacaccagctctgaagtaagcacagtagaactgctgcatctgcaacaacagcaggctctccaggcagcaagacaacttcttttacagcagcaaacaagtggattgaaatctcctaagagcagtgataaacagagaccactgcaggaattgcttccagaaacaaaattatgtatctgtggccactcttctggtgatgggcatcctcacaacacatttgcagtgcctgtgtcagtggccatgatgactccccaggtgatcacccctcagcaaatgcagcagatccttcagcaacaagtcctgtctcctcagcagctacaagcccttctccaacaacagcaggctgtcatgctgcagcaggtaatgtgggttacctgctttggtgttctagcatgacttagaaggtgtgcacttattttgaaagtgcagtgggcatatttgacaattcagtctccatttgaaaggacaacctattagcgtgctagaacataaatgtaacattttaattatagaactcgtaagaaaatctagattgcttatttttttaaaaaaattattaaagtctagaataagagcagagagaggtgtaatttgaaaatggaatgagccaatatttaaatattcaaa

SEQ ID NO: 403 - DNA, 3974 bp, Homo sapiens
  CDS (1)..(2463)
atggaagatacagaaaataactgttggaagatagatttggatcatattttgacacacctatggtgccaagaggaggagtttgtgcttcaatccaaaagcaacaggaaacagttgaaggattctacaaagaaattaaaggatgttcttgaagaattccatggtaatggtgtgcttgcaaagtataatcctgaagggaaacaagacattcttaaccaaacaatagattttgaaggtttcaaactattcatgaagacattcctggaagccgagcttcctgatgatttcactgcacaccttttcatgtcatttagcaacaagtttcctcattctagtccaatggtaaaaagtaagcctgctctcctatcaggcggtctgagaatgaataaaggtgccatcacccctccccggactacttctcctgcaaatacgtgttccccagaagtaatccatctgaaggacattgtctgttacctgtctctgcttgaaagaggaagacctgaggataagcttgagtttatgtttcgcctttatgacacggatgggaatggcttcctggacagctcggagctagaaaatatcatcagtcagatgatgcatgttgcagaataccttgagtgggatgtcactgaacttaatccaatcctccatgaaatgatggaagaaattgactatgatcatgatggaaccgtgtctctggaggaatggattcaaggaggaatgacaacgattccacttcttgtgctcctgggcttagaaaataacgtgaaggatgatggacagcacgtgtggcgactgaagcactttaacaaacctgcctattgcaacctttgcctgaacatgctgattggcgtggggaagcagggcctctgctgttccttctgcaagtacacagtccatgagcgctgtgtggctcgagcacctccctcttgcatcaagacctatgtgaagtccaaaaggaacactgatgtcatgcaccattactgggttgaaggtaactgcccaaccaagtgtgataagtgccacaaaactgttaaatgttaccagggcctgacaggactgcattgtgtttggtgtcagatcacactgcataataaatgtgcttctcatctaaaacctgaatgtgactgtggacctttgaaggaccatattttaccacccacaacaatctgtccagtggtactgcagactctgcccacttcaggagtttcagttcctgaggaaagacaatcaacagtgaaaaaggaaaagagtggttcccagcagccaaacaaagtgattgacaagaataaaatgcaaagagccaactctgttactgtagatggacaaggcctgcaggtcactcctgtgcctggtactcacccacttttagtttttgtgaaccccaaaagtggtggaaaacaaggagaacgaatttacagaaaattccagtatctattaaatcctcgtcaggtttacagtctttctggaaatggaccaatgccagggttaaactttttccgtgatgttcctgacttcagagtgttagcctgtggtggagatggaaccgtgggctgggttttggattgcatagaaaaggccaatgtaggcaagcatcctccagttgcgattctgcctcttgggactggcaatgatctagcaagatgcctgcgatggggaggaggttacgaaggtgagaatctgatgaaaattctaaaagacattgaaaacagcacagaaatcatgttggacaggtggaagtttgaagtcatacctaatgacaaagatgagaaaggagacccagtgccttacagtatcatcaataattacttttccattggcgtggatgcctccattgcacacagattccacatcatgagagaaaaacacccagagaaattcaacagtagaatgaagaacaaattttggtattttgagtttggcacatctgaaactttctcagccacctgcaagaagctacatgaatctgtagaaatagaatgtgatggagtacagatagatttaataaacatctctctggaaggaattgctattttgaatataccaagcatgcatggaggatccaatctttggggagagtctaagaaaagacgaagccatcgacgaatagagaaaaaagggtctgacaaaaggaccaccgtcacagatgccaaagagttgaagtttgcaagtcaagatctcagtgaccagctgctggaggtggtcggcttggaaggagccatggagatggggcaaatatacacaggcctgaaaagtgctggccggcggctggctcagtgctcctgcgtggtcatcaggacgagcaagtctctgccaatgcaaattgatggggagccatggatgcagaccccatgcacaataaaaattacacacaagaaccaagccccaatgctgatgggcccgcctccaaaaaccggtttattctgctccctcgtcaaaaggacaagaaaccgaagcaaggaataatcctgtgttgtttcactcttagaaattgaattagcataattgggccatggaacacatatgctggaaatctttgaaccatttcaagtctcctgctcatgcaaaatcatggaagtggtttaacagtttttgttactaagctaatgtaaaattcagctattagaaaatttattgtctcagtttttataggcatctttgcatgaagaaagcagaagtttacctgaagtgatactgcatatttttggtgcatgcattcccatagatttttacatctcccacccaactcttccccaatttccttttactaacctgtgagaaaaacccgtgaaacatgaaaaaggaaataccatgggaaacgtgattctcagtgtgattccaattattacgaagcactaatcagtaacgctacaatgatcataattgcagattgctatacgtttcccttttagaatcagtgtatcagtgacctatgacttgaggagaaacttttaattcgaagattttattaaatagttgactacaataccttgctatatatacatagtttttcttcaacatcttaactcttctgagtggaaataaaaatatcaggcataaggttttctcatgctgaaaaatagaacgcggtttttattttgcttagttttctttttaattccagaaataagtgaaaacatgttacttgacagtcaagtgtggtaatatggcaagccttgttcctttctgcatgagaatctaggagagaattcataaccacaccaataacgaaatagaagttttaaactatgtgcctaatcaatgtgtttcccaccaaagattcagaaaacaatgcttgagagaaatgggttaatgcataattaattaagcattgtggagcaaatttagggttcctgtgattaattttgtgatgactaaaatgctggaaagcaagtgagttgcccattaattatgattaaaattctcacctttcacagacagacaataagccagacaacacaatcaaagctcaatagatgatttcttgcttttttcagtcatttataaatataggtgtaatttttcatggatcagttaagtacacttgaaggaagtaaatgattgtatcagtttatttctagtataaatgggtacctgtaataatactgagctcttggaagcgaatcatgcatgcaattagctccctcctcctcacctactccactcccatctttatgacatttcaaatgtttatttggaaacaacagcctagatcactgttgaaggtgttcatggcatagttggagtctctgactgtttaaagaaatcacagaacagtacttttcttttagtgtttcattaagcctatgatgtaaaatgaaatgcttctgagcagtcttgtaatattgttcattcatattgacctgcatctcatcattgcatgttttatgttttcaaacatgccataaggaaaacgagtgcctgaactgcatgatttattagtttctctccactctgcattaaagtgctaatgattt

SEQ ID NO: 404 - DNA, 1348 bp, Homo sapiens
  CDS (194)..(1285)
agccttcgcgataaacgggctgtcctacgggctgctgcgctcgctgggccttgccttccctgaccttgccgagcactttgaccgaagcgcccaggacactgcgtggatcagcgccctggccctggccgtgcagcaggcagccagccccgtgggcagcgccctgagcacgcgctggggggcccgccccgtggtgatggttgggggcgtcctcgcctcgctgggcttcgtcttctcggctttcgccagcgatctgctgcatctctacctcggcctgggcctcctcgctggctttggttgggccctggtgttcgcccccgccctaggcaccctctcgcgttacttctcccgccgtcgagtcttggcggtggggctggcgctcaccggcaacggggcctcctcgctgctcctggcgcccgccttgcagcttcttctcgatactttcggctggcggggcgctctgctcctcctcggcgcgatcaccctccacctcaccccctgtggcgccctgctgctacccctggtccttcctggagaccccccagccccaccgcgtagtcccctagctgccctcggcctgagtctgttcacacgccgggccttctcaatctttgctctaggcacagccctggttgggggcgggtacttcgttccttacgtgcacttggctccccacgctttagaccggggcctggggggatacggagcagcgctggtggtggccgtggctgcgatgggggatgcgggcgcccggctggtctgcgggtggctggcagaccaaggctgggtgcccctcccgcggctgctggccgtattcggggctctgactgggctggggctgtgggtggtggggctggtgcccgtggtgggcggcgaagagagctgggggggtcccctgctggccgcggctgtggcctatgggctgagcgcggggagttacgccccgctggttttcggtgtactccccgggctggtgggcgtcggaggtgtggtgcaggccacagggctggtgatgatgctgatgagcctcggggggctcctgggccctcccctgtcaggcttcctaagggatgagacaggagacttcaccgcctctttcctcctgtctggttctttgatcctctccggcagcttcatctacatagggttgcccagggcgctgccctcctgtggtccagcctcccctccagccacgcctcccccagagacgggggagctgcttcccgctccccaggcagtcttgctgtccccaggaggccctggctccactctggacaccacttgttgattattttcttgtttgagcccctcccccaataaagaatttttatcgggttttaaaaaaaaaaaa

SEQ ID NO: 405 - DNA, 5967 bp, Homo sapiens
  CDS (4819)..(5967)
atggactcggagtacgtcctatgctcttggaaaggccgactatggccagcaaaggttttgtgcacacgtgggacttcaccaaaaacgaagcctgaaaaggcgatttctctagaagttcaaatcctcgcagtagatgaaaaaatcaaggtgaaaagcacagacgtgaagaccccaactaagtttgagatggaagacattgccgcctctgcagcagcacagacgaagctcggtgccccactcagagagaagatggggtacagaggaacccttcgggtggccctggagattctgaaagagagaacaaatctgggtggaggaaggaaaccacatgaactagagagcaccacaccctctcagctttctcaaaaggtgcccgaaaagccagccagttctgtccctcgtgaagatgactggagatgcaaaggcgacctaaggaggagtcttgggaagagggaaaacccaagctcaccgacggtcccttcagagagtaagcgtgccctgcgggatgacaggtcgcaggagcccacagccattgcccctactccaggcgccctgcccggggacaggtcaggggcgcccagggccattgcccctactccaggagccatgctcagtggcaggtcacgggcacgcagggccattgcccctacaccaagcgccctgcgaggttacaggtcttgggcgcacagggccattgcccctaccccaggctgcctgtacagtgacaggtcacgggcgcacagggccattgcccctgctcgaggcaccaagcatggtggcaggtcatgggcatgcaggtccattgcccccaaaccaggctccctgtgcggggacaggtcacaggcgagcagggccattgaccctaccttaggcgccaggcgcggtggcaggtcacgggcccacagagccattgcccctactccaggctccctgtgcggcaacaggtcacgggcttgcggagccattgcccttactccaggtgtcctgtgcggtgtcaggtcacgggtgccaaaggacattacccctactccaggcgccctgcgaggttacaagtcatgggtgtgcagggccattgcccctactccaggtgccctgcgcggagacaggtcagcagcacgcacggccattgtccgtactccaggtgcccttggcagggacaggtcacgggcacgcagcgccattgcttctactccagggaccctgcagggaaacaggtcatctgtgtccaaggccattgcccctgctccaggtgccctgcgtggagacaggtcagcagcgcgcacggcctttgtccctactccaggcgcccttcacagggacaggtcacgggcccgcagcgccattgcttctactccagggaccctgcggggaaacacgtcatctgcgtgcaaggccattgcccctactccaggtgccctgcgaggttacaagtcatgggcgcgcagggccattgcacctaacccaggtgcctggcgcggttacaggtcaacgacaggcaccgccattgcacctaatctgggcgccctgggcggcaacaggtcagcggcacgcacggacattgcccctactccaggcgccctgcgaggttacaggtcatggacgcgcagggccattgcccctactccaggcactctgagcagttacaggtcaccagtgcgcagggccattgcccctactccaggcactctgagcggttacaggtcacgggcacgcacggccattgcccctactccaggcaccctgcgaggttacaggccacggtcccgcagggccattgcctctactccagccaccctgcgtggtgaaaagtcacgggcgcacaccagccttgcccccgccccaggtgctttgcgcggtgacggttcacgagcacgcagggccattgtccctactacatgcccattgtgcgagatatggtcacgggtgggcataggcattgcccctattgcagatgccctgcgccgtgacaggccaccagtgcgcagggccattgctcctactccaggcgccctgcgctgtgacaggtcacgagagctcacagccattgatcctactccaggagctctgtgcagtgacaggtcaggggcaagcagggccattgcccccactccaggcactttgtgcagtgaaaggtcccgggtgcgcagggccattgcccctactccatgcgcactgtgcgggaaggggtcacaggtgggcatgggcgttgcccctactccaggtgcactgcgcagggacaggtcacaggcaggcagggccattgcacctactccatccgcactgttcagggttgggtcacgggtgggcacaggcattgcccttcctgcaggtgccctgcaccgtgacaggtcaccggtgcgcagggccgttgctcccactccaggcaccctgcactgtgacgggtcacgaaaatgcacggccactggttctactccaggagccctgcccggcgacaggtcaggggtgagcaaggccactgcccctgctccaggcgccttgtgcagtgaaaggtcccgcgcacgcaggagcattgcccctactccatgtttactgtgcggggacaggtcatgggtgggtatgggcattgcacctactccaggcgccctgcttggtggcaaatcaaggaaatgcagggccattgctattactcccggcgccctgcgtggtggcaggtcacagaaacgcagggtcgttgctcctactccagaggccctgcacggtgacgggtcatggacttatatggccattgctcctactccaggtgccctgcacggtgacagctcaccagcccacacgtccattattccctctccaggcgccctgcatggtgacgggccaccagcgcacatggcctttccttctactccaggcaccctgcatggtgatgcctctcacgcacacatggccattgctcctactccaggcacgatgcgcggtgacagctcaacagcgcgcacggccactgccccatctccaggggccctgcgaggtgacaggtcatggaaacgcaaggccattgcttctactccaggtgccctgcatggtaacaggtctgacaggtcacggaaatgcaaggccattgcttctactccaggcaccctgcacgttgagaggtcaccagcactcagggccattgttccaactccaggcaccctgggccgtgacagctcaccagggcgcacgtccattattccttctccaggcgccctgcatggtgacaggtcaccagcacacctggacattgcttctactccaggcgccctgcacggtgacagctctcaggcacacacggccattgctcctactccaggcaccatgcgcggtgacagctcaacagctcgcatggccattgccccatctgcaggggccctgagaggtgacaggtcatggaaacgcaaggccattgcttctactccaggtgccctgcgtggtaacaggtctgacaggtcacggaaacgcaaagccattgcttctactccaggtgccctgctcggtaacaggtctgacaggtcacggaaacgcaaggccattgctcctactccaggtgccccgcgcattgacaggtcaccagcatgcagggccattgctcctactccaggcgccctgggtgatgacagctcaacggccattgcccctactccagggaccccgcgaggtgacagttcgccagcaaacacggccattgcttctactccaggcgccctgcacggtgacacctctcagacacacaaggccattgctcctactccaggtgacctgggcggtggcagctcatcagcgcacaaggccatcgctccttctccaggtgccctgcatggtgacaggtcaccagcacacacggccattgcttctactccaggagccctgcatggtgacagctcccaggtgcacacgaccattgctccaactccaggcgccctgcgcgatgacaagtcatggaaacgcaaggccattgctcccactccaggcaccctgcactgtgacagctcacgaacgtgcaccgcctttgctcctactccaggcgccctgcatgctgacaggtcaccagcgcaccaggacattactcttacttcaggcgccctgcactgtgacagctcaagagaaagcagggccgttgctcctattctaggcgccctgcaccgtgtcggctctcaggcacacaaggctattgcttctactccaggccctctgcgcggtgacagctcaccatttcacacagccattgcacctatgccaggggccctgcatggtaccaggtcatggaaacgcgaagccatttctcagactccaggcaccctgtgtggtgacagctcaggagaacgcatggccattgctcctactccaggcgccctgcacagtgacaggtcacagacacatacggccatcgatcctactccaagtgtcctgcgcagtgacagctcaccagcgtgcatggccattgatcctactccaggtgccctgggcagggacaggtcacaggcgctcatggccattgctcctactccagttggaatgcaagcacatgtgttgcaaagcccccgagcctgccaggattccctgacgctttcgcggcatgtttgtgagaaaaaggggaagaaaagggcaaacgcctcaactcttatgtccctgcctcccacagtaacggaggagggtgcatctctgcctccaggtctcaccagccctgcaccccccgctctgaaggaagagacacaggacagccgcccgaagaaggccctggctgcatccccggaaagttctcccttctcggggaacattcaggaccccggagagggtgcctggaagccaggctgggcaggtatggctgcatcctctgggtcccgtcagcacaggctgccttcttcactccggcttgccaatagaaaaaggaagcgtccaggtccagattttcagaggagacctcaaggacctcagacgcctggtgacgctaagcttgctaatcctgtcaccaccattcaaagggctggcggtaaacaggatgggcagccccccagccttgcttttccacaggagccacatcccatcgaaaggggaacgatggtctggttcaaatttcaagatcatccgttttggccagcagtggtcaagagtgtcagcaacacagacaagaccgcgagggtgctcctgcttgaggccaacctgcaccatggaaagcggggcattcaagttcctcttcgaaggctgaagcacctggattgtaaggagaaagagaaactgctgaagagagcccagaaggcctacaagcaaagcgtcaactggtgcttctcactgatctcccactacagagaaggactggtccggggttctttccggggctctttcctggactattatgccgcagacatcagctacccaatcaggagagccatccaagagggagacctgcagattgactttccaaaggtgaattatggcgacctggaagactgggaggaggagacctccctgggcgggaagaggccttgcaagaaaatcctcccggaccggatgagggcctcttgggaccgagacaaccagaagctcgtggacttcatcgtgaggagaaagggggccgacccccaccttctggacatcttgcaaggcaggaagcagtccaggtggctgaccgcgtttctgaagccacacagggatttgcactgcattgaaacatacctggaggatgacgatcagttggaagtcgtggccaagcatttacaagaaatctacaagcaaattgacaaggccaggctgactctgataagggatgacaaagtcaattttgttctggaagttcttctgccggaagccatgatttgtaccatcgccgcacttgatgggctggattacaaggcagcagaggagaagtacctgcgaggaccacctgtgcattaccgggagaaagagctgtttgacagaaatatcttaaagaaggcaagaagagaaccagcaaccacccatacagctaattag

SEQ ID NO: 406 - DNA, 2822 bp, Homo sapiens
  CDS (66)..(2822)
tgtcgttgttctgaggctagcagattccttctggacctgtagggtgccgccctagcccagccgccatggcgcagggtttcgcagtgggcttcgacccactgggcctaggagacctgagctccggctctctgagctccctctcctcccgaggccacctaggcagcgactcaggctccaccgcaacgcgatacctgctaaggaagcaacaacggctgctgaacgggcccccccgcggaatccgagcctcatcgcccatgggacgcgtcatcctcatcaactcccccatcgaagccaacagtgatgaaagtgacatcatccattcagtccgggtggagaagagtccagcagggaggctgggcttcagcgtgcgcgggggctcagagcatggcctgggcatcttcgtcagcaaagtggaggaaggcagcagtgcagagcgggctggcctgtgcgtgggggacaagatcacggaggtgaatgggctgagcctggagagcaccaccatgggtagcgccgtaaaggtgctgaccagcagcagccgcctgcacatgatggttcggcgcatgggccgtgtgccgggcatcaagttctccaaggagaagaccacgtgggtggatgtggtgaatcggcgcctggtagtggagaagtgcggttcaacaccctccgacaccagctcagaagatggtgtccggcgcatcgtccacctatacacaacctccgacgacttctgcctgggcttcaacatccgtgggggcaaggagtttggcctgggcatctatgtgtccaaagtggaccatggtgggctggccgaggagaatggcatcaaggtgggggaccaggtcctggcagccaacggtgtcaggtttgacgacatcagccacagccaggccgtggaggtgctgaagggccaaacgcacatcatgctgaccatcaaggagaccggccggtatcctgcctacaaggagatggtttctgagtactgctggctggaccgactgagcaacggggtgctgcagcagctgtccccggcctctgagagcagctccagcgtctcttcgtgcgcctccagcgccccccacagctcgggctccctgccgtcggaccgcatggacatctgcctcgggcaggaggagcccggcagccgcggcccaggctgggggcgggcggacacagccatgcagacggagcccgatgcgggaggccgggtggagacctggtgcagcgtgcggcccacagtcatcctcagggacaccgccatccgctcggacggcccccatcccggccgccgccttgactctgcgctctctgagtctcccaagacggctttgctgctggccctcagccgaccccggccccccatcacgcgctcccagagctatctgaccttgtgggaggagaagcagcagcggaagaaggagaagtcggggtcccctggggagaagggtgccctgcagcgctccaagacgctgatgaacctcttcttcaagggagggcggcaggggaggctagcgcgggacgggcgcagagaggcctggacactggacagcgggagcctggccaaaacttaccctcgcctggacatagagaaagaccaggagaggggccgggccctgctgtctgccaggtctgggagtccctccagccagctgcctaatgtggatgagcaggttcaggcctgggagagccggcggcccctcattcaggacctggcccagaggctgctgactgatgacgaggtgctggctgtcacccgccactgctcccggtatgtgcacgagggaggcatagaggacctggtgaggcccctgctggccatcctcgacaggccggagaagctgctactgctgcaggacatcaggagtgtggtggcccccacagacctgggccgcttcgacagcatggtgatgcttgtggagctggaggcttttgaggccctcaagagcagggcagacagccgcggaggcttctacctgctgccggtgaacggcttcccggaagaggaagataatggggagctgagggagcggctgggggccctcaaggtctccccaagtgcctctgcccctcgccacccccataaagggatcccccctctacaagacgtgccagtagatgccttcacccccctccgaattgcctgcacaccccctccccagctaccccccgtggctccccggcccctgcggcctaactggctgctgacagaacccctgagccgagagcaccctccgcagagccagatccggggccgggctcagagccgtagccgcagccgtagccgcagccgcagccgcagcagccggggtcaaggcaagtctccaggtagacgctccccatccccggtgcctacccctgcccccagcatgaccaatgggcgctaccacaagcctcggaaggccagaccccctctgccacgacctctggatggggaggcagccaaggtgggggccaagcaagggccctcggagagtggaactgaggggacggccaaggaggcagccatgaagaaccccagtggcgagctgaagacagtgacactgtccaagatgaagcagtccttaggtatcagcatttctgggggcattgagtccaaggtgcagcccatggtgaagatagagaagatcttccctgggggggccgctttcctcagtggggccctgcaggctggcttcgagcttgtggcagtggacggagagaatctagagcaggtgacccaccagcgtgcagtagacaccatccgtcgggcttatcgaaacaaggcccgggagcccatggagcttgtgactcctgattctaagcccgcaccctccccacgcatcccatga

SEQ ID NO: 407 - DNA, 1934 bp, Homo sapiens
  CDS (28)..(1245)
ccctttgccaggcagaaagggtttcccatggggccgcccctggcgccgcgcccggcccacgtacccggggaggccgggccccggaggacgagggaaagcaggccgggcgccgtgagcttcgcggacgtggccgtgtacttctctcccgaggagtgggaatgcctgcggccagcgcagagggccctgtaccgggacgtgatgcgggagaccttcggccacctgggcgcgctgggattttcagttcccaaacccgcttttatctcgtgggtggaaggagaagtggaggcgtggagcccggaggcccaggatcccgacggtgagagctctgcagctttcagcaggggccaaggacaggaagcaggatccagggatgggaatgaggagaaggaaaggctgaagaagtgtccaaaacaaaaagaggtggcgcatgaagtggctgtcaaggagtggtggcccagcgtcgcctgcccagagttctgcaaccctaggcagagccccatgaatccctggctcaaggacactctgacccgaagactgccccactcttgcccagactgtggccgcaacttcagctacccttccctcctggccagccaccagcgggtccactccggggagcggcccttctcctgcggccagtgtcaggcgcgtttctcccagcgcaggtacctgctccagcatcagttcatccacaccggcgagaagccctacccctgccccgactgcgggcgccgcttccgccagaggggttccctggctatccacaggcgggctcacaccggggagaagccttacgcgtgctcagactgcaagagtcgcttcacttacccctacctgctggccatccaccagcgcaagcacacgggcgagaagccctacagctgccccgattgcagcctccgtttcgcctacacctccctgctggccatccacaggcgcatacacaccggcgagaagccctacccctgtcctgactgcggccgccgcttcacctattcttccctcctcctcagtcaccggcgcattcactccgacagccggcccttcccctgcgtggagtgtgggaaaggcttcaagcgcaagaccgccctggaagcccatcggtggatccaccgctcctgcagcgagaggcgcgcgtggcagcaggccgtggtggggcgttcagagcccatccctgttttgggaggcaaggatcccccagttcacttccggcactttccagatatatttcaagagtgtgggtgatggcgttcacacaaactggtcagcgtttccctgcttctaccgcgggtgtacacatggtttgccagggtgtgcgcgtcttcccaaggggtctggggaccaaattccagctcccgccatcgggaggcacggtaagagaccgtaggggacacaatcccgagcaccgcagatgccgaggtctccgctgcgctccagtctgtcaacagaggcttcaggaccgcggggtcccttcaaatgccccgccagtcacagaccaatcgccgcgcagcttcttccgggatcgtcgccaatcatcggccgttgcgtattgcgggtacagaggggattcccaggccccaaaccagccctcatctcttggatggaacaggagagtgaggcttggagccccgccgcccaggatcctgagaagggggaaagactgggaggagctcggagaggagatgtcccaaacaggaaggaagaggaaccggaggaagtcccaagagccaaagggcctagaaaggctcctgtgaaggagagtcctgaagtgctggtggaacgcaaccctgacccagctattagcgtggccccggcacgggcacagccacccaaaaatgctgcctgggacccgaccacaggagcacagcccccggcacccatacccagcatggatgctcaggccggccagcggcgccacgtgtgcacggactcgg

SEQ ID NO: 408 - DNA, 1068 bp, Homo sapiens
  CDS (100)..(1068)
tttcgtcgcgtcatgccaggcgctgctcggcggtagggagtgcccggtgccgccgtctccgcccgcccgaagccgcgcccactgcccagagccagagggatggtggtagtcacggggcgggagccagacagccgtcgtcaggacggtgccatgtccagctctgacgccgaagacgactttctggagccggccacgccgacggccacgcaggcggggcacgcgctgcccctgctgccacaggagtttcctgaggttgttccccttaacatcggaggggctcacttcactacacgcctgtccacactgcggtgctacgaagacaccatgttggcagccatgttcagtgggcggcactacatccccacggactccgagggccggtacttcatcgaccgagatggcacacactttggagatgtgctgaatttcctgcgctcaggggacctcccacccagggagcgtgttcgagctgtgtacaaagaggcccagtactatgccatcgggcccctcctggagcagctggagaacatgcagccactgaagggcgagaaggtgcgccaagcgtttctgggactcatgccctattacaaagaccacttggagcggattgtggagatcgcccggctgcgtgcggtccagcggaaggcccgctttgccaagctcaaggtctgtgtcttcaaggaggagatgcccatcaccccctatgagtgtccgctcctcaactccctgcgatttgagcggagtgagagtgacgggcagctttttgagcaccactgtgaagtggatgtgtcttttgggccctgggaggctgtggctgatgtttatgacctgctgcactgcctggtcacggacctctcggcccagggtctcaccgtggaccaccagtgcatcggggtgtgtgacaagcacctcgtgaaccactactactgcaagcgccccatctatgagttcaagatcacatggtggcggctgtatttggaaactcccattggtccagagagacagaacaatgagaagaaatcccctgtccagttgcctgcaggagtattccaacacttcatgggctag

SEQ ID NO: 409 - DNA, 3168 bp, Homo sapiens
  CDS (985)..(3168)
atggccttgagaaaacgaaagcacacgcaggcactgcgccgcacaagcccagtagggcgcgggaacccgatggaatgcggaacgtcgctgctcggcagctccctacggctggcggctgcgacccgcgtgggccgcgagttgtggcggcgggttccggggcccccccacagcatccgtcctcttgtcccaccgcccgtcggacagtcggtcggtctttcgtggccccgcgcgcccgctgcccggctcgtgcgtttcctttgcttgctgcctccggctccgctccccgcagcccagcgggttgttatcattattcaggcccaagttcacgggcactgcatccatttccctcgcgtggcccggggccaactcaggccgcaggttgcgatgctcgagcccttggacccggcctctccgcctacgtcggccatcagagcctcgctcgctgcccgagagcctcgcattgacgccggcccgcgcgtgagtcaagcctgcgtcacggcgccccgccgccagggtggcctttcggaaagcgagggaacagtgcgcgcagcgctccgcccagctccgttctgctccgcagagccggcgctgccaggggcagggagggcggcactcggccccagtcttcgcaatcccgcgcgctctctccgccgtgggacctgggttccgcgccgctcccctgagcccgagcgcgcgcggcgggacagagttgggactggtggtgaggcagggagtgaggagcgagcggagtcgcgtgtccggctccagctccgagtcgccccagccccagccgtgcgctgtgcgtgggggaggagctgtgcgtccgtacccgtcaggaccgcagctgctcggccggagtgcacgggccgagtctgcgcgactacccacgcgtgacaggtccctgaatgagaaggagctgacagcagctgaattccatcttctctgtgtgctggggagcagggctacacggcccaggtggcatcaatgccgaagaacagcaaagtgacccagcgtgagcacagcagtgagcatgtcactgagtccgtggccgacctgctggccctcgaggagcctgtggactataagcagagtgtactgaatgtggctggtgaggcaggcggcaagcagaaggcggtggaggaggagctggacacagaggaccggccggcctggaacagtaagctgcagtacatcctggcccagattggcttctctgtgggcctcggcaacatctggaggttcccctacctgtgccagaaaaatggaggaggtgcttacctggtgccctacctggtgctgctgatcatcatcgggatccccctcttcttcctggagctggctgtgggtcagaggatccgccgcggcagcatcggtgtgtggcactatatatgtccccgcctggggggcatcggcttctccagctgcatagtctgtctctttgtggggctgtattataatgtgatcatcgggtggagcatcttctatttcttcaagtccttccagtacccgctgccctggagtgaatgtcctgtcgtcaggaatgggagcgtggcagtggtggaggcagagtgtgaaaagagctcagccactacctacttctggtaccgagaggccttggacatctctgactccatctcggagagtgggggcctcaactggaagatgaccctgtgcctcctcgtggcctggagcatcgtggggatggctgtcgttaagggcatccagtcctcggggaaggtgatgtatttcagctccctcttcccctacgtggtgctggcctgcttcctggtccgggggctgttgctgcgaggggcagttgatggcatcctacacatgttcactcccaagctggacaagatgctggacccccaggtgtggcgggaggcagctacccaggtcttctctgccttgggcctgggctttggtggtgtcattgccttctccagctacaataagcaggacaacaactgccacttcgatgccgccctggtgtccttcatcaacttcttcacgtcagtgttggccaccctcgtggtgtttgctgtgctgggcttcaaggccaacatcatgaatgagaagtgtgtggtcgagaatgctgagaaaatcctagggtaccttaacaccaacgtcctgagccgggacctcatcccaccccacgtcaacttctcccacctgaccacaaaggactacatggagatgtacaatgtcatcatgaccgtgaaggaggaccagttctcagccctgggccttgacccctgccttctggaggacgagctggacaagtccgtgcagggcacaggcctggccttcatcgccttcactgaggccatgacgcacttccccgcctccccgttctggtccgtcatgttcttcttgatgcttatcaacctgggcctgggcagcatgatcgggaccatggcaggcatcaccacgcccatcatcgacaccttcaaggtgcccaaggagatgttcacagtgggctgctgtgtctttgcattcctcgtggggctgttgttcgtccagcgctccggaaactactttgtcaccatgttcgatgactactcggccaccctgccactcactctcatcgtcatccttgagaacatcgctgtggcctggatttatggaaccaagaagttcatgcaggagctgacggagatgctgggcttccgcccctaccgcttctatttctacatgtggaagttcgtgtctccactatgcatggctgtgctcaccacagccagcatcatccagctgggggtcacgcccccgggctacagcgcctggatcaaggaggaggctgccgagcgctacctgtatttccccaactgggccatggcactcctgatcaccctcatcgtcgtggcgacgctgcccatccctgtggtgttcgtcctgcggcacttccacctgctctctgatggctccaacaccctctccgtgtcctacaagaagggccgcatgatgaaggacatctccaacctggaggagaacgatgagacccgcttcatcctcagcaaggtgcccagtgaggcaccttcccccatgcccactcaccgttcctatctggggcccggcagcacatcacccctggagaccagcggtaaccccaatggacgctatgggagcggctacctgctggccagcacccctgagtcggagctgtga

SEQ ID NO: 410 - DNA, 913 bp, Homo sapiens
  CDS (23)..(475)
tcgatcatcttcgctagcagggatggacatgatgctgttggtgcagggtgcttgttgctcgaaccagtggctggcggcggtgctcctcagcctgtgctgcctgctaccctcctgcctcccggctggacagagtgtggacttcccctgggcggccgtggacaacatgatggtcagaaaaggggacacggcggtgcttaggtgttatttggaagatggagcttcaaagggtgcctggctgaaccggtcaagtattatttttgcgggaggtgataagtggtcagtggatcctcgagtttcaatttcaacattgaataaaagggactacagcctccagatacagaatgtagatgtgacagatgatggcccatacacgtgttctgttcagactcaacatacacccagaacaatgcaggtgcatctaactgtgcaaggtatgtattttcagaactgctatattgtgaaagactgtgcttagaaatatttaatatttaggtatcaaaatgactaggaagcagttaacaatgttgaaatatttgctgtcattgaaatatttgttgaattatattgtcatagttttcaggaatttacattcctagacatcagaaagtcattaagagtcatacagacagaatgaaaaagtcttttgactggctttcagttgaaacacacacgcgcacacacatacgcgtctttattaaaaggtatgcaagtattgtagtcattaagaagtgtaatgactattacaggcatacaaatccctacttacaaagataaagaaatatccattaacaccatattatgacatttgtaactgattcacctcatatcttgctttgattcatcccttcataaatctgtgggggcccatgatgacacttagatgtttgaaccttcaatagatactggaattttt

SEQ ID NO: 411 - DNA, 1195 bp, Homo sapiens
  CDS (67)..(1017)
cggacgcgtgggcagccttgctagagtctgaggactatccagggcctgactgccagctagccagccatgggccaggattattactctgtgctcgggatcactcgcaattcagaggatgcccagatcaagcaggcgtaccgcagactcgcccttaagcaccacccgttgaagtcaaatgagccgtcttcagcagagattttcaggcaaatagcagaggcctacgacgtgctgagtgaccccatgaagagaggcatctacgacaagtttggagaagagggcctgaagggtgggattcctttggagtttggatcccagaccccatggacaactggttacgtcttccacggcaaacctgaaaaggtgttccacgagttctttggtggaaacaaccccttcagtgagttttttgatgcagaaggaagtgaggtagatttgaactttgggaggctccagggccgaggggtcaagaagcaggacccccaagtcgaacgggatctctacctgtccctggaggacttattctttggctgcaccaaaaaaattaagatctccagaagggtgctgaacgaggatgggtactcctccaccatcaaggacaagatcctgaccattgatgtgaagcccggttggaggcagggcacacgcatcacctttgagaaggaaggggaccagggccccaacatcatcccagcagacatcattttcatcgtaaaggagaagctacaccctcgcttccgcagggagaatgacaacctcttcttcgtgaaccccatccctcttggcaaggctctcacctgctgcactgtggaggtgaggaccctagatgaccgtctgctcaacatccccatcaatgacatcatccaccccaaatacttcaagaaggtgccaggggaggggatgccattgccggaggaccccactaagaaaggggatctcttcatcttcttcgacatccagttccccacccgcctcacaccccagaagaagcagatgctgcgccaggcattgctgacatgactgtggtgggctggagcaggggtgaaaggaggctagccgggcctcaccccacccctacccgccacagcctcagggtgtgcaggggagcctgctgcacagatatgatacaagggtgggatggcgcagggcttaaactgacataataaagatctatttcctgtcctccaaaaaaaaaaaa

SEQ ID NO: 412 - DNA, 1883 bp, Homo sapiens
  CDS (355)..(1269)
atgcagaaccagatcagccaccgctgccgggcggactcaccgtctgcagaccctcaggccctgggagtttctcggcccgacctttgccctccgtcctgttcctgtttgctgcagcagccaggggaggagcagccaccagctcaagccccagggcacgtctgcaccgccgcccaccatctgcagcccaccccggggcaggacgctcctgcctccacagccccggggacatggcctcggtcccctgcaaaccccagccccgtagccctgcgaggttacagacagcctaaacgccaccaccacagggcctgtgccgtgcccctgacccgggcacagaaggccactggcccggaggccatggagacggtgcccccagcagtggacctggtgctgggtgcttctgcctgctgcctggcctgtgtcttcaccaaccccctggaggtggtgaagacgcggctgcagctgcagggggagctgcaggcccggggcacctacccacggccctaccatggcttcatagcctctgtcgctgctgtggcccgagcagacgggctgtggggcctgcagaaggggctggctgccggccttctgtaccaaggcctcatgaatggcgttcgtttctactgctacagcctggcgtgccaggctggcctcacgcagcaaccaggtggcaccgtggttgcgggagccgtggcgggggcactgggagccttcgtggggagccctgcttacctgatcaaaacgcagctgcaagctcagacagtggccgcagtggccgtgggacaccagcacaatcaccagactgtcctgggtgccttggagaccatctggcggcagcaagggctcttggggctgtggcagggcgttggtggggctgtgccccgagtcatggtgggctcagctgcccagctggccaccttcgcctctgccaaggcctgggtacagaagcaacagtggctccctgaggacagctggctggtggccctggctgggggcatgatcagcagcatagccgtggttgtcgtcatgactcccttcgatgtggtcagcacgcggctatacaatcagccggtggacacagctggcaggggccagctctatgggggcctcaccgactgcatggtgaagatctggcggcaggagggccccctggcactctacaagggcctgggccccgcctacctgcgcctgggcccccacaccatcctcagcatgctcttctgggacgagcttcggaaactggctgggcgggcccagcacaagggcacctagacgacggccctcacccccacgtcctgacacggccggcacttggccggaagtgagagcctgctccaggacaactggctgtcccggggcgggccatgggcccaggccctgccagaggtcccgggagagtgtggacagctctggtccatccagccccttggcccacccaggtccagagcatccacttcaagttaccacccattctgtcttccagacagttctcttccttctctgtactgcgtactgggtcaccacatcccagagccttgctcagttatagcaactgctgcgggcgtgcacatggcataggcccagtaacttacatacatcggctcacttaggcctcagacagcagcacgaggcaggcacttttacttcttttaccattagaaagccaaggcctagagtggtgggctttgaccacagccacacaattttgaagtggcagagccaggactggagcttagccctgctcaccctagacctatgcgcttgacaagtgcgtgactgtgacaggcccatgggcccggactgcccataggggtcactgtaccatggcaaaggctgaggtgcaccaggaggctgtggcgtcgtcacctgccttatttgctggagaa

SEQ ID NO: 413 - DNA, 1460 bp, Homo sapiens
  CDS (30)..(1460)
cagggtctgaattattcaaacgtagtctcatgtctggattggaacaaatggaagagctgaggacaggagtgacaggagttctgcaggaattggatttgcaactcaaaaccaaaggctccccactgctgcaagatatttctgcagaaagatcaccaaatggagtacaattggagagaagcaatactgcagagaaactgtatgactctaaccattctggaaaagtcttcaatgaacacccatttcttatgactcacatgataactcacattggagagaaaacttctgaggataatcagagtggaaaagccttaagaaagaactttcctcatagtttttacaagaaaagtcatgctgaggggaaaatgcctaagtgtgttaaacatgaaaaagccttcaaccagtttccaaatcttactaggcagaataaaactcacacacaagagaaattgtgtgaatgcaaagactgttggagaacttttcttaatcagtcatcccttaagttacatataagatctcacaatggagacaaacactatgtatgtaaggaatgtgggaaagccttcagtaattcctcacaccttataggacatggaagaattcacagtggagagaagccctatgtctgtaaagaatgtggtaaagctttcactcaatccacaggacttaaattacacatcagaactcacagtggagaaaaaccatataaatgtaaagagtgtgggaaagccttcacccattcttcataccttactgatcatacaagaatccacagtggaaagaagccctatgtatgtatggaatgtggaaaagccttcactagatccacaggacttattttacacatgcgaattcacactggagaaaagccatatgaatgtaaggagtgtggaaaagcttttattcattcctcataccttacaaaacatgtaaggattcacagtggagagaagctgtatttatgtaaggcatgtgggaaagcttttactcgttcctcaggacttgttttacacatgagaacacatactggagaaaagccctatgaatgtaaagaatgtgggaaagcctttaataattcctcaatgcttagtcaacatgtaaggattcacactggagagaagccatatgaatgcaaagaatgtgggaaagctttcactcaatcctcgggccttagtacccatttaagaactcacactggagaaaaggcctgtgaatgtaaggaatgcggtaaagcatttgctcgttccacaaatcttaatatgcacatgcgaacgcacacaggagaaaagccttatgcatgtaaagaatgtgggaaagccttcaggtattccacataccttaacgttcacacacgaactcacactggagcaaaaccatatgaatgtaagaaatgtgggaaaaacttcactcaatcttcagcacttgctaaacatctaagaactaaggcatgtgaaaaaacctga

SEQ ID NO: 414 - DNA, 522 bp, Homo sapiens
  CDS (223)..(522)
tttcgtagcattctccttatctcatctgcacaggaagcaggtctaagtgtaatttcacaagcccctgactctgtatagacacccagctctccagaaaaatgctttgaagacaaaggatacagcatacagtcccgtgtctcggctgagtcatcgcattccttaatagtgtcttctccccgggtttggtggcctgcttctggagtggtcagttctgctgccgacatgcccacccagctcgagatggccatggacaccatgattagaatcttccaccgctattctggcaaggcaaggaagagattcaagctcagcaagggggaactgaaactgctcctgcagcgagagctcacggaattcctctcgtgccaaaaggaaacccagttggttgataagatagtgcaggacctggatgccaataaggacaacgaagtggattttaatgaattcgtggtcatggtggcagctctgacagttgcttgtaatgattactttgtagaacaattgaagaagaaaggaaaataa

SEQ ID NO: 415 - DNA, 1232 bp, Homo sapiens
  CDS (240)..(1097)
cgggtcaaggtccgcgggcctcgcagattgtagcccgttcgcacgcgatcagatgatcctgttgtggacggctaagttgtaggcgggatggctgagaaagcggcgctaggacccccgggcagaggctcggggaagggagtcaggggggaaatgccttacaaggtcgccttgcggtcaccatcattgcccgccgcccaaaatagcccccggcgccagctggcctgccctatggccgagagatggctgctgcctccgagcccgtggattcgggtgcactctggggactcgagcgcccggagccccctcccacccgcttccatcgggtgcacggtgccaacatccgcgtggacccctctgggacgcgggccacacgcgtggagagcttcgcccacggcgtgtgcttcagccgcgagccgctggccccgggccaggtcttcctggtcgagatcgaggagaaagagctgggctggtgcggacatctgcgtctcggtctgaccgcgctggaccccgccagtctggcccccgttcccgagttttctctgcccgatctggtcaacctgggccacacctgggtcttcgccatcacgcgccaccacaaccgcgtgccccgggagggccgcccggaggcggaggcagcggcccccagccgacctccaaccctcctcgtggaaccatatctgcgcattgagcagtttcgcattccccgggaccgcctggtgggccgcagccggccagggctctacagccatctcttggaccagctctatgagctgaacgtgctgcctccgaccgcgcgccgtagccgcctgggtgtcctcttttgcccgcgccccgatggcacggccgacatgcacatcatcatcaacggcgaggacatgggcccgagcgcccggggactgccagctgcgcagcccctctacgcggtggtggacgtgtttgcttccacaaagagcgtgcgccttgtccagctcgagtatggcttgccatccctgcagactctgtgccgcctagtgatacaaaggagcatggtgcaccggctggccattgatgggctccacctgcccaaagaacttaaggatttctgcaagtatgagtgaagacccacagtgcaccagagcacagctgcatcctggggccccagacctgtggctggctggtccgaagttggccacattgctgccagccaagaccagaaataaacagccgatgctgacatcttgaaaaaaaaaaaa

SEQ ID NO: 416 - DNA, 2560 bp, Homo sapiens
  CDS (233)..(1321)
aatgatgaaatcccctgatgaaaaacctaacacatttcttagaatgtatgcctgttctttagtgatgcatgactgtttttgacttcttatataactcacggaagagctgtttaggtttggatgatacatctctagatcactatgaatctctggtggaagaaagacctaaaatcaacttatagggtgggatattattattttaccattttaccactttctatgttaaaatgttatgtcgtatcgtaaattaacattgtttttctcaatagctgttcgtgatcgcatggtccctcctccaccaccaccccaccatctctatgcgaaggctaacacctcatcttccatcttcctgcactggaggaggcctgcattcaccgctgcacaaatcattaactacaccatccgctgtaatcctgttggcctgcagaatgcttctttggttctgtaccttcaaacatcagaaactcacatgttggttcaaggtctagaaccaaacaccaaatacgaatttgccgttcgattacatgtggatcagctttccagtccttggagccctgtagtctaccattctactcttccagaagcaccagcaggcccaccagttggagtaaaagtgacattaatagaggatgacactgccctggtttcttggaaaccccctgatggcccagaaacagttgtgacccgctatactatcttatatgcatctaggaaggcctggattgcaggagagtggcaggtcttacaccgtgaagcaaaagcaccacccccaaaacaagactttactcaaggagcaaccaaaaacactaatcaaaattcctctgctcatccacctcacttgaatatggatgacacagtgaatcagagtaatattgaattaaaaaatgttaatcgaaacaatgcagtaaatcaggagaacagccgttcaagtagcactgaagccacaaacaataaccctgcaaatgggacgcagaataagccacgacaaccaagaggtgcagcagatgcctgcaccacagaaaaaagcaataaatcctctcttcacccaaaccgtcatggccattcgtcttctgacccagtgtatccttgtggaatttgtacaaacgaggtgaacgatgatcaggatgccatcttatgtgaggcctcttgtcagaaatggtttcatcggatctgtactggaatgactgaaacagcttatggcctcttaactgcagaagcatctgcagtatggggctgtgatacctgtatggctgacaaagatgtccagttaatgcgtactagagaaacttttggtccatctgcagtgggcagtgatgcttaatcaaaggcattaactaaagtgggtttattttcctgtgcattgcagaagttcattgacacaggattttaatgttttacattatttttttaaatgcatacacaaaaacattatttacttagtttttattaatcacttcatcactagagcaaattttttattgtctttgcttgctgtcttaaatgagaataatgtatatgggggtgctttagaaacataaataaatgttagttgttgttatttatcacaaacataaaagcctcttgaaacttcaaaataatatataacaaatgtaggcaagttttaacttttaaaagttagaatcattgaaaaacatgtatttcagtgctgaactttggttgtaccatattaaagatttagttcaaaaagtttatcaaggatccacttaacacgtcttcacaacataatatatgtaactgtaacatgggggagagcatacatttttatggattaaaaaaataatagtatgacaccagattcctcctccactagggtctttggaatcaatgaatttcatatttcaagtgagttttcaggatatctgtttgtacagatacgagacagatcttagcatatagtaaattctcagtaagtattgttgattaacttgtggatggtaccacatgaaattgctaatattagatcagttgaaaattgactgcaattagtaaagttggtataacgtacgttcccagttgtgctatttagaattatgatagtattatgctcctacttttctttgatattgagttgtcttgttattgtttattgttttccagagaaatactatagtatccacagaagaattgtgaatacttttttataattttgaactgggacatattgcagatgaggaaggtagaaacatccatttggccttagagggctctgctagtaaaagaactactcagtggtggtttgaaaaatcttgttctggggatctgaatttcaaaaatgaaccctaggggagatcaaaatccattttaaacaaagatcaattaagagccaaagtgaaatctaacttgcaaacaacaatttgaagccttgcagcagacttaaggaattcccgctctgactggggaaaagtataaaaatggacctgagagtaccctctcgagggatgatcaagaatggagacagttggaggtgtgctcattaagattcaaaacagcagaaatccatttttggagcagattataacctgtggccaaaaaaaaaaaa

SEQ ID NO: 417 - DNA, 3275 bp, Homo sapiens
  CDS (398)..(2863)
gctggcaccatgcccccccctgcagaggtgacggacccgtcccatgcccccgccgtcctgcgccagctcaatgaacagcggctccgtggcctcttctgtgacgtcaccctcatagccggagacaccaagttccctgctcaccgcagcgtcctggctgcttcaacctctccccctgcttcttccccacccccgggtcctggagttgccaggagtcccagcagctgcgttttctgatgtcctcaacttcatctacagcgcccggctcgcactgcctggtggtggaggggacggggcagctgtagcagagattggagctttggggcgccgtctgggcatctcccgccttcagggcctgggggagggaggtgatgcctgggtacctcctaccccagcccccatggccacctcgcagcctgaagaggacagctttgggcccgggcccaggccagctggggagtgggagggtgacagggctgaggcccaggcccctgacttgcagtgctccctgccccggcggcccctcccctgcccccagtgtggaaaaagcttcatccatcccaaacggctgcagacccatgaggcccagtgccgacgaggggccagcacgcgggggtctacagggctgggagctgggggcgctggccctggtggtcctgcaggggtggacgcctcagccctgcctccaccagtgggcttccgagggggccccgagcacgtggtgaaggtggtgggcggccacgtgctgtatgtgtgcgcggcctgcgagcgttcctacgtgaccctgtccagtctgaagagacacagcaatgtacactcgtggcggaggaagtacccctgccgctattgtgagaaagtgtttgctctggcggagtaccgcacgaagcatgaagtgtggcacacgggggagcgcaggtaccagtgcatcttctgttgggagacctttgtcacttactataacctgaagacccaccagcgagccttccacggcattagcccgggcctccttgccagtgagaagacacccaatggaggctacaagcccaagctcaatacactcaagctctaccgcctgctccccatgcgggcagccaagcggccctacaagacctacagccagggagccccggaggctcccctttctccaaccctcaacacaccggcccctgtggcaatgccagccagcccgccgcctgggcctccacctgccccagagcctggccctccaccctctgtcatcacttttgcccacccagccccctctgtcattgtccatgggggcagtagcagtggtggaggggggagtgggacggccagcacaggagggtcccaagctgcctcggttatcacttacactgctcccccgaggccacccaagaaacgagaatacccacctcctccccctgagcctgcagccacacccaccagcccagccacagcagtcagcccagccaccgctgcagggccagccatggccaccaccacggaggaggccaagggccggaatccacgggctggaaggactctgacttacacagccaagccagtgggcgggattggtggaggtgggggtccccccacaggggctggccggggcccctctcagctgcaggctccacctccactgtgtcagatcactgtgcgaataggggaggaggccatcgtcaagcgccgcatctcagagactgacctgcgtcctggggagctgagcggagaggagatggaggagagtgaggaggacgaagaggaggaggacgaagaggaggaggaggaggatgaggaggaatcaaaggctggtggggaggaccagctctggaggccctactactcctacaagcctaagcgcaaggctggagctgctggaggtgccagtgtggggggcagtgggctgccccgaggccgccggccaccacgttggaggcagaagctggaacggaggagctgggaggaaaccccagcggccgagagcccagcgggacgtgcccgcacagagcggaggcaccgatgcggggactgtgcccagaccttcaccaccctgagaaagctgcggaagcaccaagaggcccacggtgggggctcccacagctcccgggccggacggaggccctccacccgctttacctgcccccactgcgccaaggtgtgcaagaccgcagctgccctgagccgccacgggcagaggcatgctgctgagcggcccgggggcaccccaacccctgtcattgcctattccaagggcagcgctggcaccaggcccggggatgtcaaggaggaagccccccaagagatgcaagtctcctcatccagcggtgaggcaggtggcgggagcactgctgctgaggaagcttccgagaccgcctcactccaggaccctatcatttcagggggtgaggagcccccagtagtggcaagcgggggcagctatgtatacccacctgtgcaggaatttccactggccttgattgggggcggccgggaacctggcggtggcaggggaaaatctgggagtgaagggccagtgggggctggtgagggggaccggatggaggggataggggctgccaaagtcactttctaccctgagccctacccgctcgtctatggcccccagctccttgccgcctacccttacaacttcagtaacttggccgctctcccggttgctctcaacatggtcctacctgatgagaagggtgcgggggcccttcccttcctaccaggggtctttggctacgcagtgaatcctcaagcagcaccccctgccccaccaacaccacctcccccaactcttcctccaccaattccccctaagggagaaggggaaagggcaggggttgagagaacccagaagggcgatgtggggtgaaccctggggctcaatccccctttcaccagatgccaccctccctgaaccccccaccactaccagctccctggcctccctgccccttgggagccccttcacactcttgtgcagggacttgggggcccctggagctcaggggtcaggctgctttgtgtgagatgtagttttcccatctcctgggaagggatctttcgaggttcccctctcagtcttcctccagggaatggcctccatgaggggcagggccagcttccatcccttctccacgccttggggcaactgagcaatatacttaacctgaatctctactcacagcccccaccagctctgaatgtctaacctgctaccctgattcgtgcacctaggggaaaccatctctctcagtcgacgggccgcgaatttagtagtagta

SEQ ID NO: 418 - DNA, 1831 bp, Homo sapiens
  CDS (146)..(1561)
gaattcccgggtcgacgatttcgtcgccccgcggagttccatgggtcctgcacagcatcaggcctgagccgccggtccaactgctccaggtcatcagtttgccccatcattggttaaggtggtattctctacattataaagctcgatggagtttgtgacagccctggtgaacctccaagaggagtctagctgtcccatctgtctggagtacttgaaagacccagtgaccatcaactgtgggcacaacttctgtcgctcctgcctcagtgtatcctggaaggatctagatgatacctttccctgtcctgtctgccgtttttgctttccatacaagagcttcaggaggaacccccagctccgtaatttgactgaaattgctaaacaactccagattaggaggagcaagagaaagaggcagaaagagaatgccatgtgtgaaaaacacaaccagtttctgaccctcttctgtgttaaagatctagagatcttatgtacacagtgcagtttctccactaaacaccagaagcactacatttgccctattaagaaagctgcctcttatcacagagaaattctagaaggtagccttgagcccttgaggaataatatagaacgagttgaaaaagtgataattctgcaaggcagcaaatcagtggagctgaaaaagaaggtagaatataagagggaagaaataaattctgagtttgagcaaataagattgtttttacagaatgaacaagagatgattcttaggcagatacaagatgaagagatgaacattttagcaaaactaaatgaaaaccttgtagaactttcagattatgtttccacattaaaacatctactgagggaggtagagggcaagtctgtgcagtcaaacctggaattactgacacaagctaagagtatgcaccacaagtatcaaaacctaaaatgccctgaactcttttcatttagattaacaaaatatggtttcagtcttcctcctcaatattctggcttggacagaattatcaagccatttcaagtagatgtgattctagatctcaacacagcacatcctcaacttcttgtctctgaggatagaaaagctgtgcgatatgaaagaaaaaaacgaaacatttgttatgacccaaggagattttatgtctgccctgctgtcctaggctctcagagatttagttctggccgacattactgggaagtagaagtgggaaacaaacctaaatggatattgggtgtgtgtcaagactgtcttcttaggaactggcaggatcagccatcagttctgggcggattctgggcaattgggcgatacatgaagagtggttatgttgcgtcaggtcctaagacaacccagcttctgccagtagtaaaacccagtaaaattggtatttttctggactatgaattgggtgatctttccttttataatatgaatgataggtctattctctatacttttaacgattgtttcacagaagccgtttggccttatttctatactggaacagattccgaacctcttaaaatctgctcagtatcagattctgaaagataaggaactggtaaatgggtctgtttcagtttttgtaggtaacttagccagtaaatttaatctcatttctggactctttaagttttaccactgaaaaccagagtcgatttttctcctaaatttttggcaactataagatgttcataatgccactttcatatattctatgaatatcaattgtcaggtgctttgatttctaagataaaatattttagaattatgttacttaacatgtccaataaaatgttttcaaattgcaaaaaaaaaaaaaaa

SEQ ID NO: 419 - DNA, 2162 bp, Homo sapiens
  CDS (364)..(2010)
atgactgtcaccaactccttgcagggcagtcagcccggagatagagtaatcaaggtggccgagagcaggggacagcgccctggcgacctcctcagggatcctagattaacagtcgcgtcctcaaacgcagcatcctgcgtaaccgccaatttcaaacttccaagacctgccctgctgattttgcccttccctttttccctccgtctggcctcgctgttgctggagaggccaggtcctgcctcagtgcttttggcttggctgtttcgtttgccacggatgtctttctttccccagatatcaacatggcttgctggtcattcgcttcaggtcttcaagtcttgggtcaaatgcgccagtggggagatgttgaagttcaaatatggagcgcggaatcctttggatgctggtgctgctgaacccattgccagccgggcctccaggctgaatctgttcttccaggggaaaccaccctttatgactcaacagcagatgtctcctctttcccgagaagggatattagatgccctctttgttctctttgaagaatgcagtcagcctgctctgatgaagattaagcacgtgagcaactttgtccggaagtattccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtttcattttttgaggaagagcggaacatattatctcgaagcacaagcccgtggatcccccaattacagtatgcctttcaggacaaaaatcacctttatctggtcatggaatatcagcctggaggggacttgctgtcacttttgaatagatatgaggaccagttagatgaaaacctgatacagttttacctagctgagctgattttggctgttcacagcgttcatctgatgggatacgtgcatcgagacatcaagcctgagaacattctcgttgaccgcacaggacacatcaagctggtggattttggatctgccgcgaaaatgaattcaaacaagatggtgaatgccaaactcccgattgggaccccagattacatggctcctgaagtgctgactgtgatgaacggggatggaaaaggcacctacggcctggactgtgactggtggtcagtgggcgtgattgcctatgagatgatttatgggagatcccccttcgcagagggaacctctgccagaaccttcaataacattatgaatttccaggtgttggacaatcagataaagaaagacctggctgacaaggagacactggagaacatgatgcagagacacgaggaggaggcccatgagaagggcaaaattctcagcgaacagaaggcgatgatcaatgctatggattccaagatcagatccctggaacagaggattgtggaactgtctgaagccaataaacttgcagcaaatagcagtctttttacccaaaggaacatgaaggcccaagaagagatgatttctgaactcaggcaacagaaattttacctggagacacaggctgggaagttggaggcccagaaccgaaaactggaggagcagctggagaagatcagccaccaagaccacagtgacaagaatcggctgctggaactggagacaagattgcgggaggtcagtctagagcacgaggagcagaaactggagctcaagcgccagctcacagagctacagctctccctgcaggagcgcgagtcacagttgacagccctgcaggctgcacgggcggccctggagagccagcttcgccaggcgaagacagagctggaagagaccacagcagaagctgaagaggagatccaggcactcacggtaggtctggggagcaacatcttcaggttgctaaaggcctcagctaggatgagtgtggaactggcactgagtatactggctcacccttagaaattccaggagggaaaacatgatccacaaagatattcagtggccaggaaattggcttacataggctgctgcttcattggaactagtagatgagcttggttggttatattcaaacttttcttagtatcttgaatagctcctcctttacttat

SEQ ID NO: 420 - DNA, 916 bp, Homo sapiens
  CDS (103)..(828)
gcaaaaaggagaccagacaggaggcgtctgtagagatatcatgaacttcaacttagctttgttttccagagactggagctaaactgggctttcaacatcatcatgaagtttatcctcctctgggccctcttgaatctgactgttgctttggcctttaatccagattacacagtcagctccactcccccttacttggtctatttgaaatctgactacttgccctgcgctggagtcctgatccacccgctttgggtgatcacagctgcacactgcaatttaccaaagcttcgggtgatattgggggttacaatcccagcagactctaatgaaaagcatctgcaagtgattggctatgagaagatgattcatcatccacacttctcagtcacttctattgatcatgacatcatgctaatcaagctgaaaacagaggctgaactcaatgactatgtgaaattagccaacctgccctaccaaactatctctgaaaataccatgtgctctgtctctacctggagctacaatgtgtgtgatatctacaaagagcccgattcactgcaaactgtgaacatctctgtaatctccaagcctcagtgtcgcgatgcctataaaacctacaacatcacggaaaatatgctgtgtgtgggcattgtgccaggaaggaggcagccctgcaaggaagtttctgctgccccggcaatctgcaatgggatgcttcaaggaatcctgtcttttgcggatggatgtgttttgagagctgatgttggcatctatgccaaaattttttactatataccctggattgaaaatgtaatccaaaataactgagctgtggcagttgtggaccatatgacacagcttgtccccatcgttcacctttagaattaaatataaattaactcctcaaaaaaaaaaa

SEQ ID NO: 421 - DNA, 1197 bp, Homo sapiens
  CDS (197)..(1066)
tttcgtggctccccgctcccattgtctcggcagatgccgcctggtccagctatcgtgctcggtattcagttttccggagcagcgctctttctctggcccgcggagcggtcccgcggccgagtaccggattcccgagtttgggaggctctgctttcctccttaggacccactttgccgtcctggggtggctgcagttatgtccgcgctgcgacctctcctgcttctgctgctgcctctgtgtcccggtcctggtcccggacccgggagcgaggcaaaggtcacccggagttgtgcagagacccggcaggtgctgggggcccggggatatagcttaaacctaatccctcccgccctgatctcaggtgagcacctccgggtctgtccccaggagtacacctgctgttccagtgagacagagcagaggctgatcagggagactgaggccaccttccgaggcctggtggaggacagcggctcctttctggttcacacactggctgccaggcacagaaaatttgatgagttttttctggagatgctctcagtagcccagcactctctgacccagctcttctcccactcctacggccgcctgtatgcccagcacgccctcatattcaatggcctgttctctcggctgcgagacttctatggggaatctggtgaggggttggatgacaccctggcggatttctgggcacagctcctggagagagtgttcccgctgctgcacccacagtacagcttcccccctgactacctgctctgcctctcacgcttggcctcatctaccgatggctctctgcagccctttggggactcaccccgccgcctccgcctgcagataacccggaccctggtggctgcccgagcctttgtgcagggcctggagactggaagaaatgtggtcagcgaagcgcttaaggttggagggggcctgagtatgggcagggcccagggagggagaggtggaagtgagagagaccccacaaggaagaaacagccaccagccagcaggacaggccttgggctctgtctgcctccaggccctggtgtcctaggatgaattaggaaggagggggctggagtgaaacctccaatggtccacgatccatgatctctgaccccctcctcccctctgtggacccataccctcctcagtccccaagggcctgctcatctccatagcagtaggag

SEQ ID NO: 422 - DNA, 902 bp, Homo sapiens
  CDS (37)..(528)
cttcagcaagctacctgcagccctctgtctgacatcatgtccttcaactgctccacaagaaattgctcttccaggcccattggaggacgctgcattgttccagtggcccaagttaccacgacttccaccactgatgctgactgcctgggcggcatctgtttgcccagttccttccagactggctcttggctcctggaccactgtcaagagacctgctgtgagcccactgcttgccagccaacctgttaccggcgaacttcatgtgtctccaacccttgccaggtgacttgctctcgacaaactacctgtatttccaacccctgctcaactacctacagccggccgctcacctttgtctctagtggaagtcagcccctgggaggcatctccagtgtctgccaaccagtgggcggcatctctactgtctgccaaccagtgggaggagtctctactgtctgccagccagcctgtggggtctccaggacgtatcagcagtcctgcgtgtccagctgccgaagaacctgctaagtgtgtaggagccagtgagcgaatcaagactccacgacctgccagctgtttccaggatcttccagcatgctgcttgtccctgaatagctcttcatagctgacccttcttgtgaccgcctgactgctggctactatccatgcacacgctgctttacactctaaattttctgccagccctaacttgtttagggtgctactgtgctgtgatgcctctggtgtgtccagaagctttaccatccacaccccagtctctgatgcttttgacatgttttcaccttgctgctgtatctcctggcctctggctttgtgtctcacaaaaacagagcttgtctcaaccatgatttctcaataaaccctgcattagttggcattgc

SEQ ID NO: 423 - DNA, 3143 bp, Homo sapiens
  CDS (15)..(3083)
aatggattaagaacatggagaaggcgaataaactggctgtcatcaagttctctgatagcaactacatgaggatgctggaaaacgcgctgcagttaggcacccctgtcttgattgaaaacattggagaagagctggatgcttctatcgaacctatcttgctcaaggcaacattcaaacagcaaggagttgagtacatgaggctgggtgaaaacatcattgaatattccagggattttaagttatacatcacaacccgtttgaggaatccacattacctcccagaagttgccgtgaaggtctgtctcctcaacttcatgatcacccccttgggtctccaagatcaactccttggcatcgtggctgcgaaggagaagccagagttggaagagaaaaagaaccagttgattgtggaaagtgccaagaacaagaagcatctcaaggaaattgaagataagatcttggaggttctctccatgtccaagggtaacatcctggaggatgaaaccgccatcaaagttctgtcctcctccaaagtgctatctgaagagatctcagagaaacagaaagttgcttccatgacagaaacgcagattgacgagactcggatgggctacaagccagtggctgtgcattctgccaccatcttcttttgtatctcggacctggccaacatcgagccgatgtaccagtactccctgacttggttcataaatctctacatgcattccttgacccacagcacgaagagcgaggaactgaatctgcgcatcaagtacatcattgaccatttcaccctgagcatctacaacaacgtgtgccgttctctgtttgagaaggacaagctactcttctctctcctcctgaccatcggcatcatgaaacagaagaaggaaattacggaggaggtgtggtacttccttctcactggaggcatcgcactggataacccctaccccaatccagctccccaatggctgtctgagaaggcatgggcagagattgtccgtgcatctgccttacccaaactgcatggcctgatggagcatttggaacagaacctgggtgaatggaagctgatctatgactcggcctggccccatgaggagcaactccctgggtcttggaagttctctcaaggattggagaagatggtgatccttcgatgtttgcggcctgacaaaatggtgccagcggtccgggagttcattgctgaacatatgggaaagctgtatatcgaagcccctacgttcgatctccagggatcctacaatgattccagctgctgtgcgcctttgatttttgtgttgtctccaagtgcagacccaatggcaggcctgctgaagtttgctgatgatcttggtatgggaggtaccagaacacagaccatctcccttggccaaggccaaggccctattgctgccaaaatgatcaacaatgccatcaaagacgggacctgggtggtcttacagaactgccacctggccgcaagctggatgcctaccctggagaagatttgtgaggaggtgattgttcctgagagcaccaatgccagattcagactctggctaaccagctatccatcagagaagtttccagtcagcattctccagaatggaatcaaaatgaccaatgagccccccaaagggctccgggccaacctgttgcgctcctacctcaatgaccccatctcagatcctgtgttcttccaaagctgtgcaaaggcggtgatgtggcaaaagatgttatttggcctttgtttcttccacgccgttgttcaagagagaagaaacttcggccccctagggtggaatattccctatgaattcaacgaatctgacctgaggattagtatgtggcagatccagatgtttctcaatgactacaaggaggtgccctttgatgctctgacctacctgacaggggaatgtaattacggaggcagagtgactgatgacaaagaccggcgtctcctgctgtcacttctgtccatgttctactgtaaggaaattgaggaggactattactccctcgctcctggagacacttactacatccctcctcatggctcctaccagtcctatatcgactatctcaggaatctccccatcacagcccacccagaagtgttcggcctccatgagaacgcagacatcaccaaagacaaccaggaaaccaaccagctgtttgagggggtcctgctgaccctccctagacagtcaggaggaagtggcaagtcccctcaggaagtggttgaggagttggcacaagacattctctccaagcttcccagagactttgacctggaagaggtcatgaagttgtaccccgtggtctatgaagaatccatgaataccgtcctaaggcaggagctcatcagattcaacaggctgaccaaagtggttcggaggagcctcatcaatcttggccgagccatcaaaggacaggtcctgatgtcctcggagctagaggaagtctttaacagcatgcttgtgggtaaagtgccagccatgtgggcagccaagtcttacccatcactgaagcctctggggggctacgtggctgacctgctggcccgcctgaccttcttccaggaatggattgacaaggggccccctgtggtattttggatctctggattctacttcacacagtcttttttgactggcgtctctcaaaattatgcccggaaatataccatccccattgaccacattggatttgagtttgaggtaaccccacaagaaacagtgatggagaataaccccgaagatggggcctacatcaaagggctcttcttagaaggtgcccgttgggacaggaaaacgatgcagattggggaatctctccccaaaatcctctatgacccactgcccatcatttggctgaaacctggggagagcgcaatgtttctgcatcaggacatctatgtgtgtccagtctacaaaacaagtgcccgcagaggaaccctctccaccacaggccactctaccaactatgtcctctccattgagcttccaacagacatgccccagaagcactggataaaccgaggggtggcctcactgtgccagctggataactgatggcatttgtctcaagacagaaaataaaaagcatttcattcttaaaaaaaaaaaaaaaaa

SEQ ID NO: 424 - DNA, 1594 bp, Homo sapiens
  CDS (115)..(1224)
gcttgcaaagtatggcaaaggcttggcaaagactataagcttttggaaaacagggactatgtcttcttcaacaatgtgtacacaacaagtagcaggttgtttggcacatggcagatgctcggcagtacatgccacactactacccttcctgctcttgtgcgcacacctaccctgatgatgcagccttcactggatatcaaaccatttatgtcttttccagtggacagtagttctgctgttgggctctttccaaattttaacacaatggatcctgtgcaaaaagcggttattaaccatacatttggagtatccattcccccaaagaagaaacaagttatttcttgtaatgtctgtcagcttcgctttaactcagatagccaggccgaggcccactacaaaggaagtaaacatgccaagaaggtcaaagcactagacgcaacgaaaaataaacccaaaatggttccttccaaggacagcgcaaaggctaatcccagctgctccatcactccaatcacaggcaacaactctgacaaatcagaagataaagggaagttaaaagccagcagttccagtcagccatcaagctctgaaagtggctcatttctcctcaaatctggcacaacacccctgccacctggagcagccacttctccctccaagagcacaaatggagctcccggtactgttgttgaatcagaagaagaaaaagccaaaaaattactttattgttcactatgcaaagtggctgtgaactccctgtcacagctagaggcacacaacacaggatctaaacacaagaccatggttgaagctcgtaatggggctggtccaattaaatcctatcctagacctggatcaagattaaagatgcagaatggcagtaaggggtcaggactacagaacaagacatttcattgtgaaatctgtgatgttcatgttaattcagaaattcaactcaaacagcacatttctagccgaaggcataaagatcgagttgcagggaaaccactgaagccaaaatacagcccttacaacaaactccagcggagcccgagtattctagcagcaaaacttgcattccagaaagatatgatgaagcctttggcccagccttcctgtcctcacctctcgcagcggcggcatccgtgtcctcagcgctgtcactcccaccccggccctctgcctcgctcttccaggctccagccattcctccagctcttctgaggcctgggcatgggcccatccgcgccactcctgcctccatcctctttgctccgtactaacgtctgcaaaccccaagacgtttgaggccagtaggaagttgagaaagaaagccacaaggattcagcaatttaagcagtttgtgttgcagtaccccccattcacccacaaaatgcagcccaccacccagtcccccaattccagagagaaacacatcactagattgacgagggcttttagagactgctcctataattgaggaatcagcagcataggctttatctccctacttcctcccccaccctaccgcgttcaatttgtgtatctcagatatttgatttcttgagcatgtattggtcagaaaaaaaaaaaa

SEQ ID NO: 425 - DNA, 1143 bp, Homo sapiens
  CDS (178)..(1143)
atgaatccctgcggttggctgggggcagtgggtcccacactgcctaacttccctaaatgggcagcttcacttttagaaccccgggtccttccctggcaggcccaggtggcacatcctgtgtcgggtgggccctcaccttggatctccaggcctgacactgcccagctggatggaaccatggccccagccttcctgctgctgctgctgctgtggccacagggttgcgtctcaggcccctctgctgacagtgtatacacaaaagtgaggctccttgaaggggagactctgtctgtgcagtgctcctataagggctacaaaaaccgcgtggagggcaaggtttggtgcaaaatcaggaagaagaagtgtgagcctggctttgcccgagtctgggtgaaagggccccgctacttgctgcaggacgatgcccaggccaaggtggtcaacatcaccatggtggccctcaagctccaggactcaggccgatactggtgcatgcgcaacacctctgggatcctgtaccccttgatgggcttccagctggatgtgtctccagctccccaaactgagaggaacattcctttcacacatctggacaacatcctcaagggtggaactgtcacaactggccaagcccctacctcaggccctgatgccccttttaccactggtgtgatggtgttcaccccaggactcatcaccttgcctaggctcttagcctccaccagacctgcctccaagacaggctacagcttcactgctaccagcaccaccagccagggacccaggaggaccatggggtcccagacagtgaccgcgtctcccagcaatgccagggactcctctgctggcccagaatccatctccactaagtctggggacctcagcaccagatcgcccaccacagggctctgcctcaccagcagatctctcctcaacagactaccctccatgccctccatcaggcaccaggatgtttactccactgtgcttggggtggtgctgaccctcctggtgctgatgctgatcatggtctatgggttttggaagaagagacacatggcaagctacagcatgtgcagcgatccttctacacgtgacccacctggaagaccagagccctatgtggaagtctacttgatctga

SEQ ID NO: 426 - DNA, 2768 bp, Homo sapiens
  CDS (72)..(2738)
agcccaagggggtgtttgcgaaggagcagtcagtgcataatgaggtgcaggctgaggcggggaccactgccatgctgagctgtgaggtgggccagccccagacggagatggcgaccgcggcgctgcttcgaggcgccactccggggcgcggcggcccggtctggcgctggcggctgcgcgcggccccaaggtgccgcctggcccacagctcctgcagtcctggtggcgacccaacggccggagcggcctgggcctgcttccggctggacgggcgcaccctgctgcgcgtgcgtggccccgacgcggcgcccttcctgctagggctgctgaccaatgaactgccgcttccgagtcctgcggccgcgggggccccgcctgctgcgcgcgcgggctacgcccacttcctgaacgtgcagggccggacgctctatgacgtcatcttgtacgggctccaggaacactcggaggtgtctggcttccttctggagtgtgacagctcggtgcagggcgcgctgcagaagcacctcgcgctatacaggatccggcggaaggtcacggtggagccgcacccggagctgcgagtgtgggcggtgttgcccagttcccctgaggcctgcggggctgcatcgctgcaggagagggcaggggctgccgccatcctcatccgcgacccgcgaacagcacgcatggggtggcggctcctcacccaggatgaaggcccagccctggtgcccgggagccggctcggggacttgtgggattatcaccagcaccgatacctgcaaggcgttcctgagggggtccgagacttgcctcctggggtggccctgcccctggagtccaacctggccttcatgaacggcgtgagcttcaccaaaggctgctacattggccaggagctgacggcccgcacccaccacatgggcgtcatccgcaagcgcctcttccctgtccggttcttggacccccttcccaccagtggcatcacccctggtgccacggtgctgactgcctcaggacagactgtgggcaagttcagggctggccagggcaacgtggggctggccctgctgtggtcagagaagatcaagggtcctctgcacatcagagcctctgagggaaacctcctccgaaagctccctcggaagacggcggtgcgcgtgggcgacacggctatgttttgcgtggagctggcggtcccggtgggccccgtccactggctgcggaaccaggaggaagtggtggcggggggccgcgtggccatctccgcggagggcacgcgccacacactaaccatctcccagtgctgcctggaggatgtgggccaggtggcctttatggctggcgactgccagacgtccacccagttctgcgtgtcggcccccaggaagcctcccttgcaaccccctgtggatcctgtggtaaaggccaggatggagagttccgtgattctcagctggtccccaccaccccatggggaacgccctgtcactatcgacggctacctggtagagaagaagaagcttggcacctacacctggatcaggtgccacgaggctgaatgggtggctacacctgagctgaccgtggctgatgtggcggaggaggggaacttccagttccgagtgtccgctctcaacagctttggtcagagtccctacctcgagttcccggggactgtccacctggcccccaagctggccgtgaggacaccgctgaaggcggtgcaggcggtagagggtggcgaggtcactttctccgtggacctcacggtggcctcagcgggtgagtggttcctggatgggcaggccctgaaggccagcagtgtgtatgagatccactgtgatcgcacccggcacacgctcaccatccgggaggtgcccgccagcctgcacggggcgcagctgaagttcgtggccaacggcattgagagcagcatccggatggaggtccgggcggccccagggctgactgccaacaagccgccagccgcagctgcccgggaggtgctggctcggctgcacgaggaggcgcagctgctggctgagctgtcagatcaggctgcggctgtgacgtggctgaaggatggtcgcacactgtccccaggccccaagtatgaggtgcaggcatcggccgggcggcgggtgctccttgtgcgagatgtggcccgggacgatgcaggcctctacgagtgcgtcagccgcgggggccgcatcgcctaccagctctccgtgcaaggcctcgcgcgctttctgcacaaggacatggcgggcagctgtgtggatgccgtggctgggggcccggcgcagtttgagtgtgagacctccgaagcccacgtccacgtgcactggtacaaggatggcatggagctgggccactccggtgagcgcttcttgcaggaggatgtggggacgcggcaccggctggtggcagccacagtcaccaggcaggatgaaggcacctactcctgccgcgtgggcgaggactctgtggacttccggctccgcgtctctgagcccaaggcggtgtttgccaaggagcagccggcgtgcagggaggtgcaggctgaggtgggggccagcgccacgctgagctgtgaggtggcccaggaccagatggaggtgacgtggtacaaggacgggaagaagttgagctccagctcgaaagtgcacgtggaggctgtgggctgtatgcggaggctggtggtgcagcaggtgggccaggcagactccggatagtacagctgtgaagccaggtggttacaaaaa

SEQ ID NO: 427 - DNA, 806 bp, Homo sapiens
  CDS (51)..(806)
cactcactcactcacacacctcccccagctcaccgcctccccactccagcatggccgcctccaccatgtccatctgctccagcgcctgcactgactcttggcgggtagacgactgcccagagagctgctgcgagccctgctgctgtgccccagcccccagcttgaccctggtctgcaccccagtgagctgtgtgtccagcccctgctgccagacggcctgtgagcccagcgcctgccaatcaggctacaccagctcctgcacacccccatgctaccagcagtctagctgccagccggattgctgcacctcctccccctgccagcaggcctgctgtgtgcctgtctgctgtgtgcccgtctgctgcgtgcccgtctgtaacaagcctgtgtgcttcgtgcctacctgctccgagtcttccccttcatgctgccagcagtctagctgccagccaacttgctgcacctcctccccatgccagcaggcctgctgtgtgcctgtctgctctaagtccgtctgctatgtgcctgtgtgctctggggcttccacttcatgctgccagcagtctagctgccagcctgcttgctgcaccgcctcctgctgcagaccctcctcctccgtgtccctcctctgccaccctgtgtgcaagtccacctgctgcgtgcccgtcccctcctgcggtgcctctgcctcctcctgccagcccagctgctgccgcacggcctcctgtgtttccctcctctgccgccccgtgtgctcccgccctgcctgctacagcctctgctctggccagaagtccagctgctga

SEQ ID NO: 428 - DNA, 1551 bp, Homo sapiens
  CDS (171)..(1376)
gcgtgaagcttgctggctcttctttttcctatcgctccatgacaagctaacagagagagcggagagtcacaatccaaggtccggctcctccgcgtcccagggccggacggagggatgaggcagggggggcccgggcagcgccgttgctgctccccccgccgcccgcagccatggaaacggggaaggacggcgcccgcagaggtacacaaagcccggagcggaaaaggcgaagcccagtgccgcgggcgcccagcacgaagctgaggccggcggcggcggcccgggccatggatccggtggcggccgaggccccgggcgaggccttcctggcgcggcgacggcctgagggcggtggcgggtccgcgcggccgcgttacagcctgttggcggagatcgggcgcggcagctacggcgtggtttatgaggcagtggccgggcgcagcggggcccgggtggcggtcaagaagatccgctgcgacgcccccgagaacgtggagctggcgctggctgaattctgggccctcaccagcctcaagcggcgccaccagaacgtcgtgcagtttgaggagtgcgtcctgcagcgcaatgggttagcccagcgcatgagtcacggcaacaagagctcgcagctttacctgcgcctggtggagacctcgctgaaaggagaaaggatcctgggttatgctgaggagccctgctatctctggtttgtcatggagttctgtgaaggtggagacctgaatcagtatgtcctgtcccggaggccagacccagccaccaacaaaagtttcatgctacagctgacgagcgccattgccttcctgcacaaaaaccatattgtgcacagggacctgaagccagacaacatcctcatcacagagcggtctggcacccccatcctcaaagtggccgactttggactaagcaaggtctgtgctgggctggcaccccgaggcaaagagggcaatcaagacaacaaaaatgtgaatgtgaataagtactggctgtcctcagcctgcggttcggacttctacatggctcctgaagtctgggagggacactacacagccaaggcggacatctttgccctgggcattatcatctgggcaatgatagaaagaatcacttttattgactctgagaccaagaaggagctcctggggacctacattaaacaggggactgagatcgtccctgttggtgaggcgctgctagaaaacccaaagatggagttgcacatcccccaaaaacgcaggacttccatgtctgaggggatcaagcagctcttgaaagatatgttagctgctaacccacaggaccggcctgatgcctttgaacttgaaaccagaatggaccaggtcacatgtgctgcttaaaattcagggctaagcattttgggtgattttaaactaggtcgattcctcgggacccacagtctcaccacgtctcctccagaggacggcagagggtacaggtggtggcctggccggttggcgatctcccgacagctggatccggcaatgtgaagcttttgtttgggtttccccgctt

SEQ ID NO: 429 - DNA, 690 bp, Homo sapiens
  CDS (66)..(656)
actcggctcttccccaggaggaccaagccctgaatcaggtgcagtgctgcctgccccactgtgccatgggccctgggctcctctgctgggtgctgctttgtctcctgggagcaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcagcttcctagcgggggggcacgatgattcaggtagaggaggtgcttttacaaaaaaccctgatgcagtaagcatccccacccagctcagggaatgcagctaccaggtgggaagagttctctggggctggtcccagctgtggtcttgcagggtcccccaacccagcgagcacctgtccatctccctgtccagactcggcttccaaggaataagaaggccaagacagcaaagtgggattatcactcagcacttttaataaaacttgttcttgacaaagtaaaaaaaaaaaa

SEQ ID NO: 430 - DNA, 1464 bp, Homo sapiens
  CDS (1)..(1464)
atgccgaatccccaccctctgtgctgggaagcagttccagtgaccaatgagctcagtgagcttgcagatatttacttatgggatgcctactgtttgaaaaacaatgtgagggcatacacggatgaattagagcagttttttcttgtggaacatacacactgggaccaggaagatgacctgactgaggtgactttctgcagacttcggactcaccagtggtgtttcattctatttaatgtcatcctatttcatgccttgctttttgggactgactttgtggaggaatactttctgcattctttgccttatatagatgtgaaagttcttgaaattaagaataaggcaagaaaattgaacatcgaacccctaagaagtaatctctccaaatactatgtcctgagccagtcagaaatatgtaaagggaagaacatttttttgctgtctcttatcttcagtagcccaggaaatggaacaagacgggacctcattaggaaaacttggggcaatgtgaccagtgtccaagggcatcccattctcacactgtttgctctgggaatgcctgtttcggtaactacccagaaagagatcaacaaagaatcctgtaagaataatgatataattgaaggaatcttcttggacagttctgagaaccaaaccctgaagatcattgcaatgatacagtgggctgtggctttctgccctaatgccctgttcattctcaaggtggatgaagagacgtttgtcaatctaccaagcttggtagactatcttctcaatctgaaagaacacctagaagatatctatgtaggaagagttcttcatcaggttacacccaatagagatcctcagaacagagactttgtccctcttagtgagtacccagaaaaatactacccagattactgcagtggtgaggcctttataatgtcccaagatgtggctcgaatgatgtatgtggttttcaaagaagtacccatgatggtgccagctgatgtgtttgtaggaatttgtgctaagttcattggccttatacccatccacagctcaaggttttctgggaaaaggcacattagatacaacagatgttgctataagttcatttttacatcctcagaaattgcagatcctgaaatgcccctagcatggaaggaaattaatgatggaaaagaatgtacactgtttgagacatcctatgagctcatttcctgcaaacttctgacgattttgaatataccattccattcctttcttgactgcaaggtttctgaagataaatctgctgatagtcttatatatgttccattgtatgtgacaatttgctttttccttgctgctttcagcactttcactttgtctttaacttttgacaatttgattatgatgtgtcttgatgtgggtctctttggatttatcatttgctgtactttgggcttcttggatctggcttttaatttcctttcctag

SEQ ID NO: 431 - DNA, 1119 bp, Homo sapiens
  CDS (1)..(1038)
atgaagcgtcagctcacacaccttcctggccggttctggctgtggcccagcttctctgtagcgtccctcctatcccaccagaccccagccacaaattcctggcttgcttcttccaaacttcattcagccccagggatggctctgcaggatgtgtgcaagtggcagtcccctgacacccagggaccatcacctcacctgcctcgggctggcggctgggctgtgccccggggttgtgaccctcaaaccttcctgcagatccatggccccagactggcccacggcaccaccactctggccttccgcttccgtcatggagtcattgctgcagctgacacgcgttcctcctgtggcagctatgtggcgtgtccagcctcatgcaaggtcatccctgtgcaccagcacctcctgggtaccacctctggcacctccgccgactgtgctacctggtatcgggtattacagcgggagctgcggcttcgggaactgagggagggtcagctgcccagtgtggccagtgctgccaagctcttgtcagccatgatgtctcaataccggggactggatctctgtgtggccactgccctctgcggctgggaccgctctggccctgagctcttctacgtctatagcgacggcacccgcctgcagggggacatcttctctgtgggctctggatctccctatgcctacggcgtgctagaccgtggctatcgctacgacatgagcacccaggaagcctacgccctggctcgctgcgccgtggcccacgccacccaccgtgatgcctattcagggggctctgtagaccttttccacgtgcgggagagtggatgggagcatgtgtcacgcagtgatgcctgtgtgctgtacgtggagttacagaagctcctggagccggagccagaggaggatgccagccatgcccatcctgagcctgccactgcccacagagctgcagaagatagagagctctctgtggggccaggggaggtgacaccaggagactccaggatgccagcagggactgagacggtgtgagaagcaggacttggttggggatggtgtaggcctggggagtgggtgggaggatgggcagcagggggagggtcccgctggcag

SEQ ID NO: 432 - DNA, 988 bp, Homo sapiens
  CDS (47)..(988)
  misc_feature (1)...(988): n = a,t,c or g
ggtttttacctctgtnccctgactctcctttatagaagtgctctccatggagcaagtcaataagactgtggtgagagagttcgtcgtcctcggcttctcatccctggccaggctgcagcagctgctctttgttatcttcctgctcctctacctgttcactctgggcaccaatgcaatcatcatttccaccattgtgctggacagagcccttcatactcccatgtacttcttccttgccatcctttcttgctctgagatttgctatacctttgtcattgtacccaagatgctggttgacctgctgtcccagaagaagaccatttctttcctgggctgtgccatccaaatgttttccttcctcttctttggctcctctcactccttcctgctggcagccatgggctatgatcgctatatggccatctgtaacccactgcgctactcagtgctcatgggacatggggtgtgtatgggactaatggctgctgcctgtgcctgtggcttcactgtctccctggtcaccacctccctagtatttcatctgcccttccactcctccaaccagctccatcacttcttctgtgacatctcccctgtccttaaactggcatctcagcactccggcttcagtcagctggtcatattcatgcttggtgtatttgccttggtcattcctctgctacttatcctagtctcctacatccgcatcatctctgccattctaaaaatcccttcctccgttggaagatacaagaccttctccacctgtgcctcccatctcattgtggtaactgttcactacagttgtgcctctttcatctacttaaggcccaagactaattacacttcaagccaagacaccctaatatctgtgtcatacaccatccttaccccattgttcaatccaatgatttatagtctgagaaataaggaattcaaatcagccctacgaagaacaatcggccaaactttctatcctcttagttaa

SEQ ID NO: 433 - DNA, 1974 bp, Homo sapiens
  CDS (117)..(1841)
ctgagtacctctgcggaaccgccccggaatttccgggtcgacgatttcgtgaggtatcagctttctccgctagttcccaccctggtagtccttagcccctggaatgcgtgagggagatgcttagggagttctcgaagtggggcgtagaggcatcgcctggcaaggcctgggagcgaaaaagatctctacttcgtggagccgttggacgctaccggggagccactggtggggaccttttttgggccccctttccttcgtggggtactatggagttcccagaacacagtcagcagctgctgcagagcctccgggagcagcggtcccagggtttcctttgtgactgcaccgtgatggtgggtagtacccagttcttggcccatcgggctgtgctggcctcctgcagcccattcttccagcttttctacaaggagcgggaattggacaagagggatctggtgtgtattcacaatgaaattgtcacagccccagcctttgggctgcttctggactttatgtatgctggccagctgaccctgagaggggatacccctgtggaggatgtgctggcagctgccagctacttgcacatgaatgacatcgtcaaggtgtgtaagcggcggcttcaagcccgggccctggcagaggcagacagtaccaagaaggaggaggaaaccaactcacagcttcctagtttggagtttttgtctagtacttcccgtggcacccaaccttcgttggcatctgctgagacatcaggccactggggcaaaggggaatggaaaggctctgctgctccctcacctactgtccgtcctccagatgagccaccaatgtctagtggggctgacactacacagcctggcatggaggttgacgcaccacatctgcgggcacctcatccaccagtggctgatgtctctcttgccagccctagtagctccactgagaccattcctacaaactacttctcttctggcatctcagcagtttcattggagccactgccatctcttgatgtgggtcctgagagtctgagggtggtggaaccaaaggatcctggaggaccactgcaaggcttctatcccccagcctcagccccaacgtcagccccagcccctgtctcagctccagttccatcccaggctccagccccagctgaagctgagctggtccaggtgaaagttgaagctattgtgatctctgatgaagagactgatgtgtcagatgaacagcctcagggtcctgagagagctttcccatctggaggagcagtgtatggggcacagccctcccagccagaggcttttgaagacccaggggcagcaggactggaggaggtggggccaagtgaccacttcctgccaacagaccctcatctaccctaccatctgctgccaggtgcagggcagtatcatcgaggactggtgacctcacctctgcctgcacccgcatccctgcatgagccactttacctgtcttctgagtacgaagcagctccaggaagctttggggtttttactgaggatgttcccacctgcaagacatgtgggaagaccttctcatgctcttacacactacggcgacatgccacggtgcacacacgtgagcgaccctatgagtgccgctactgcctgcggagctacacgcagtcaggggacctctaccgccacatccgcaaggctcacaatgaggacctggccaaacgcagcaaaccagatccagaagtgggaccccttctaggggtgcagcctctccctggctccccaacagcagacagacagagcagcagtggtggagggccacctaaagattttgtattggccccaaaaactaacatctaagggagcatgagctgatgctaggctgctcttaccatccttagatggcagctcagaaggttggtggcaccttatcacccctgctgggtgacaagaataaaggctctgcccaggctgaaagttcaaaaaaaaaaaa

SEQ ID NO: 434 - DNA, 1006 bp, Homo sapiens
  CDS (239)..(838)
gcagacccgggcaccgcggaggctggagccgcaatggtgctgatggagggcgggagatggagctgaccaggggccggaggggctgagaagagcctgcccaagtctgggccaagcacgaagccctttcccacccgtcgggctcctgggttcccgccagccgatttccagccgtcagggtcacgccactcgctggaaaccctgaactctgtgccccccaagccctgggccccctgcgggaatgttcaaaaatgagtaccagggaggtgcatttgttgaaattttcagtgctcaaggaaaaaatcctggagcaaaatggaagatccttggtagtccatctgtgatttggaaagagtttgataaagaagttaaaagttttgtgtttgtcctggaaggcagcagccaaacaaacaaaattcagttaccaaaggagaataagcaaagccttggattgatccagaggtttcttgtacttcagatttacgtacccctgggacaagacttctccactgaattgctaattactgatttagggaacatcaaaagaagattatatttatcaacggtccataaggaactatcctccacccctcttcatgcaaaaattccactcttcatgatcaaacgtaaaatttggtgcaatctatgcattgacttagtagcattcaccagtgaaatattcaagggggcagttttccagtcattggatggaattgttgtctcagctaactgtaagctacggaagatcttcaccttaaaatcaaagccacaagacactgctgataaggatggtatgttcaggttgctatcaagattttttaattctctgatgtatttttaaaattagccatacctttgggatagtatgagtgtgtggtagcagtttgatgttatgtctgctaaagtaaatttgtcaacagtcatgctgatttctttgttctagatcaaatgtttatttttactatagctgaatgtcacaaaaaaggtattaatcttcaaaaaaaaaaaa

SEQ ID NO: 435 - DNA, 671 bp, Homo sapiens
  CDS (30)..(671)
cacgctggtacaggttcaaggtggtgcccatgcgtaaaccatcccgccgtaagtgcaaagtatgcggtgaatacttcgtgccgaaattccacgacatccggatccggtggtgcagcccggagcatggcgcaatcctcgcaatggaagaacgcaagaaggagaaggtgaaagccgcggctaagcgcatcaaggagcaaaaagaggctgaaaaggacgggcgcaaacgccgcaaggagcggctggcagagctcaggccagacggatactacaaggctcaggctcagaaagctttcaacgcctttatccgtgcgcgcgacgccgatttgccatgcatcagctgcggcgagaccaatccgcctgatctgcatggtggccagtgggattgcggccatttcaagacagtaggtgcttaccctgaactgcgctttgaagaacgcaacgcccataagcagtgcaaatcctgtaatgccggagctggcaagtacaccgccaaagaggcgaccgtggcgcagcaatacgaagctgggttggtcgctcgttacggtcagggatacgtcaactggctcaatggtccccacgaaatgaccaactaccgccgtgaagacttcatccggatccgggatgagtaccgcgacaagctcaaagcactgaaacagcgggaggcagcatga

SEQ ID NO: 436 - DNA, 2085 bp, Homo sapiens
  CDS (9)..(1523)
ctgccgagatggaggcgaccggcacctgggcgctgctgctggcgctggcgctgctcctgctgctgacgctggcgctgtccgggaccagggcccgaggccacctgccccccgggcccacgccgctaccactgctgggaaacctcctgcagctacggcccggggcgctgtattcagggctcatgcggctgagtaagaagtacggaccggtgttcaccatctacctgggaccctggcggcctgtggtggtcctggttgggcaggaggctgtgcgggaggccctgggaggtcaggctgaggagttcagcggccggggaaccgtagcgatgctggaagggacttttgatggccatggggttttcttctccaacggggagcggtggaggcagctgaggaagtttaccatgcttgctctgcgggacctgggcatggggaagcgagaaggcgaggagctgatccaggcggaggcccggtgtctggtggagacattccaggggacagaaggacgcccattcgatccctccctgctgctggcccaggccacctccaacgtagtctgctccctcctctttggcctccgcttctcctatgaggataaggagttccaggccgtggtccgggcagctggtggtaccctgctgggagtcagctcccaggggggtcagacctacgagatgttctcctggttcctgcggcccctgccaggcccccacaagcagctcctccaccacgtcagcaccttggctgccttcacagtccggcaggtgcagcagcaccaggggaacctggatgcttcgggccccgcacgtgaccttgtcgatgccttcctgctgaagatggcacaggaggaacaaaacccaggcacagaattcaccaacaagaacatgctgatgacagtcatttatttgctgtttgctgggacgatgacggtcagcaccacggtcggctataccctcctgctcctgatgaaataccctcatgtccaaaagtgggtacgtgaggagctgaatcgggagctgggggctggccaggcaccaagcctaggggaccgtacccgcctcccttacaccgacgcggttctgcatgaggcgcagcggctgctggcgctggtgcccatgggaataccccgcaccctcatgcggaccacccgcttccgagggtacaccctgccccagggcacggaggtcttccccctccttggctccatcctgcatgaccccaacatcttcaagcacccagaagagttcaacccagaccgtttcctggatgcagatggacggttcaggaagcatgaggcgttcctgcccttctccttagggaagcgtgtctgccttggagagggcctggcaaaagcggagctcttcctcttcttcaccaccatcctacaagccttctccctggagagcccgtgcccgccggacaccctgagcctcaagcccaccgtcagtggccttttcaacattcccccagccttccagctgcaagtccgtcccactgaccttcactccaccacgcagaccagatgaaggaaggcaacttggaagtggtgggtgcccaggacggtgcctccagcctcaacagtgggcatggacagggttaatgtctccagagtgtacactgcaggcagccacatttacacgcctgcagttgttttccggagtctgtcccacggcccacacgctcacttgactcatgctgctaagatgcacaaccgcacacccatacacaactacaagggccacaaagcaactgctgggttagctttccacagacataaatatagtccatctgcaatcacaagcacatagccaggtaacccaccaactcccctggatctgcagcccacacgtgggggtctggctgtcaccttcacaagccacagaaacggccacacatgttcacagctcacacgccctctccattcatcgaacttctcagtgtccctgtccctggtgcctggcacagggaacagcatgccccctccggggtcatgccacccagagactgtcgctgtctatggccccaactcatgctccctctcttggctacaccactctcccagcctgtgaccaccgatgtccacacacc

SEQ ID NO: 437 - DNA, 1714 bp, Homo sapiens
  CDS (89)..(1714)
tcgacgatttcgttctgcaatgactcctccttggacttcgccgaccgccacccttgcgtatcaaacactccgccaagcccccctcaccatggtccactccccacctgtcctgcctttgtgtgcctctgtgtctttgctgggtggcctgacctttggttatgaactggcagtcatatcaggtgtcctgctgccactgcagcttgactttgggctaagctgcttggagcaggagttcctggtgggcagcctgctcctgggggctctcctcgcctccctggttggtggcttcctcattgactgctatggcaggaagcaagccatcctcgggagcaacttggtgctgctggcaggcagcctgaccctgggcctggctggttccctggcctggctggtcctgggccgcgctgtggttggcttcgccatttccctctcctccatggcttgctgtatctacgtgtcagagctggtggggccacggcagcggggagtgctggtgtccctctatgaggcaggcatcaccgtgggcatcctgctctcctatgccctcaactatgcactggctggtaccccctggggatggaggcacatgttcggctgggccactgcacctgctgtcctgcaatccctcagcctcctcttcctccctgctggtacagatgagactgcaacacacaaggacctcatcccactccagggaggtgaggcccccaagctgggcccggggaggccacggtactcctttctggacctcttcagggcacgcgataacatgcgaggccggaccacagtgggcctggggctggtgctcttccagcaactaacagggcagcccaacgtgctgtgctatgcctccaccatcttcagctccgttggtttccatgggggatcctcagccgtgctggcctctgtggggcttggcgcagtgaaggtggcagctaccctgaccgccatggggctggtggaccgtgcaggccgcagggctctgttgctagctggctgtgccctcatggccctgtctgtcagtggcataggcctcgtcagctttgccgtgcccatggactcaggcccaagctgtctggctgtgcccaatgccaccgggcagacaggcctccctggagactctggcctgctgcaggactcctctctacctcccattccaaggaccaatgaggaccaaagggagccaatcttgtccactgctaagaaaaccaagccccatcccagatctggagacccctcagcccctcctcggctggccctgagctctgccctccctgggccccctctgcccgctcgggggcatgcactgctgcgctggaccgcactgctgtgcctgatggtctttgtcagtgccttctcctttgggtttgggccagtgacctggcttgtcctcagcgagatctaccctgtggagatacgaggaagagccttcgccttctgcaacagcttcaactgggcggccaacctcttcatcagcctctccttcctcgatctcattggcaccatcggcttgtcctggaccttcctgctctacggactgaccgctgtcctcggcctgggcttcatctatttatttgttcctgaaacaaaaggccagtcgttggcagagatagaccagcagttccagaagagacggttcaccctgagctttggccacaggcagaactccactggcatcccgtacagccgcatcgagatctctgcggcctcctga

SEQ ID NO: 438 - DNA, 5117 bp, Homo sapiens
  CDS (521)..(4024)
cgaaagccggctttgtactcaacagacagggtagccgcagattgtatgaaaatattggaaatcaatggcttctatggaatttcattaagaagcaggatccacaattgatagggcctcataatttgatggattgggctaagaaaattgtctgaaaaggtggggttgcagagtgctggccagcttccgaccgtctctccctgaagccgccccgggggaaggtgcggaggacgcagacagcgggcccgagagccgcagcgggggcgaggagaccagcgtgtgcgagaaatgctgcgccgagttcttcaagtgggcggacttcctggagcaccagcggagctgcaccaagctcccgcccgtgctgatcgtgcacgaggacgcgcccgcgccgccccccgaggacttccccgagccttcgcccgccagctcccccagcgagcgcgccgaaagcgaggcggccgaggaggcgggtgcggagggcgcggagggcgaggccaggccggtggagaaggaggccgagcccatggacgcggaacccgcgggggacacgcgcgcgccccggcccccgcctgcggcccctgcacccccaacgcccgcctacggcgcgcccagcaccaacgtgaccctggaggcgctgctgagcaccaaggtggcggtggcgcagttctcgcagggcgcgcgcgcggcaggcggctcgggagcaggtggaggcgtggcagctgcagccgtgcccctgatcctggaacagctcatggccctgcagcagcagcagatccaccagctgcagctcatcgagcagatccgcagccaggtggccctcatgcagtgcccgccgccgcggccctcactcagccccgcggccgccccgagcgcaccgggcccggcccccagccagctgcccgggctggccgcgctcccgctgtcggccggggcccctgccgccgccatcgcgggctcgggccccgccgccccggccgccttcgagggcgcgcagccgctgtcccggcccgagtctggcgccagcacccccggcggccctgcggagcccagcgcgcccgccgcccccagcgccgcccctgcccccgctgcccccgccccggcgccagcgccgcagagcgcagcttcgtcgcagccgcagagcgcatccacgccgcctgccctggccccggggtccctgctgggtgcggcgcccggcttgccaagtccgcttctacctcagacttccgccagcggcgtcatcttccccaacccgctggtcagcatcgcggccacggccaacgctctggacccgctgtccgcgctcatgaagcaccgcaagggcaagccgcccaatgtgtcggtgttcgagcccaaagccagcgccgaggacccgttcttcaagcacaaatgccgcttctgcgccaaggtcttcggcagcgacagcgcgctccagatccacctgcgctcgcacacaggcgagcggcccttcaagtgcaacatctgcgggaaccgcttctccaccaaaggcaacctgaaggtgcacttccagaggcacaaggagaagtacccccacatccagatgaacccttacccggtccccgagtacctggacaacgtgcccacctgctcgggcatcccctacggcatgtcgctgccccccgagaagcccgtgaccacctggctggacagcaagcccgtgctgcccaccgtgcccacgtccgtggggctgcaactgccgcccactgtccctggcgcgcacggctacgccgactctcccagcgccaccccagccagccgctccccgcagaggccctcgcccgcctccagcgagtgcgcctccttgtccccaggcctcaaccacgtggagtccggcgtgtcggccaccgccgagtccccacagtcgctcctcggcgggccgcccctcactaaagccgagcccgtcagcctgccctgcaccaacgccagggccggggacgctcccgtgggcgcgcaggctagcgctgcacccacatcggtggacggcgcacccacgagcctcggcagccccgggctgcccgccgtctccgagcagttcaaggcccagtttccgttcggggggctgctagactcgatgcaaacgtcggaaacctcgaagctgcagcagctggtggagaacatcgacaagaagatgacggacccgaaccagtgcgtcatctgccaccgggtgctgagctgccagagcgcgctgaagatgcactaccggacgcacacgggggagcggccgttcaagtgcaagatctgcggccgcgccttcaccaccaagggcaacctcaagacgcacttcggcgtgcaccgtgcaaagccgcccctgcgcgtgcagcactcctgccccatctgccagaagaagttcaccaacgccgtggtcctgcagcagcacatccgcatgcacatgggcggccagatccccaacacgccgctgccggagggcttccaggatgccatggactccgagctggcctacgacgacaagaacgcggagaccctgagcagctacgatgacgacatggacgagaactccatggaggacgacgctgagctgaaggacgcggccaccgacccggccaagccactcctgtcctatgcggggtcctgcccgccctccccgccctcggtcatctccagcattgccgccctggagaaccagatgaagatgatcgactcggtcatgagctgccagcagctgaccggcctcaagtccgtggagaacgggtccggggagagtgaccgcctgagcaacgactcctcgtcggccgtgggcgacctggagagccgcagcgcgggcagccccgccctgtccgagtcctcgtcctcgcaggccctgtcgccggcccccagcaatggtgagagcttccgctccaagtccccgggcctgggcgccccggaggagccccaggaaatcccgctcaagaccgagaggccggacagcccagccgccgccccgggcagcggaggcgcccctggccgcgcgggcatcaaggaggaggctcccttcagcctgctgttcctgagcagggagcggggtaagtgtcccagcactgtgtgtggtgtctgtggcaagccttttgcttgcaagagcgcgttggaaatccactaccgcagccatactaaggagcggccattcgtctgcgcgctctgcaggcgagggtgctccactatgggtaatttaaaacagcacttactgacacacagattgaaagagctgccttctcagttatttgaccccaactttgctctaggtcccagccaaagcactcctagcctgatctccagcgccgcacccaccatgatcaaaatggaagtgaacggtcacggcaaggccatggcgctgggcgagggtcccccgctgcccgcgggcgtccaggtccccgccgggcctcagacagtgatgggcccgggcctggcgcccatgctggcccccccaccgcgccggacgcccaagcagcacaactgccagtcgtgcgggaagaccttctcctcggccagcgccctgcagatccatgagcgcacgcacaccggcgagaagccgttcggctgcaccatctgcggccgggccttcaccactaagggcaacctcaaggtgcacatggggacacacatgtggaataacgcccccgcgagacgcggccgccgcctgtctgtggagaaccccatggctctcctagggggtgatgccctgaagttctctgaaatgttccagaaggacctggcagctcgggcaatgaacgtcgaccccagtttttggaaccagtatgctgcagccatcactaacgggctcgccatgaagaacaacgagatctccgtcatccagaacggcggcatcccccagctccccgtgagtcttgggggcagcgccctcccccctctgggcagcatggccagtgggatggacaaagcacgcactggcagtagcccacccatcgtcagcttggacaaagcgagctcagaaacagcagccagccgcccattcacgcggtttatcgaggataacaaggagattggtatcaactagccagtgactcgctcatctgccctgcccaggcccacgttttgaagttggagcatcaggcctccgacctttcttgcctcggttctcattacactttcacccatagcagaaaacactttgtgcggctgccgagaggtggtcttgtaagcgctgcatggcgctcccttcaacagcaagcctgactgttctcgagaactctgcaatcttttaaataagcttccttcaaaaaaaaaagtgcttggaaaaccgccttaggaacagaaagagctcagaccatgtccacttcctttctcctgaaacctaataatctctccgagggagaaaggggttctctgcggtattccagtgaaactcatttgatggtttcttttgaattagttagacacttgaacggtgttttttagaactcttcatgttaaagacgtggtttagtactcccaatgctgtgtatcatgacactatcttcgtctgtagtatttatgatgttaagataatgcgggtaacagacaatataatagccccgaccttaaacgaagcttttgtactgcagaatacatctggctgtgtgattttttttttaagcaagatttgttttactataaataagtggattatttcaatgcaggcaaaattgtgaagttctgttgggaaagatagcatgcttttcgtgtgcaagtacctgtcagtaataagccttttttttttttttttttaatttaaatgtttgtagctgctatgtggacagttgttttctagtgtggtctgtagcccaataactggggaacgagttacagacaaacatcaccgtaaatgactcacaacattataaacagttgtgagaaaatatttcacattatcaaagctgtacaataaaaaggtaatgtttgtataatgtggttgcaaactcttaatttatactattgcacttttagtattttgtattagggaggtttgtctataatttgaaaatttaaaaaaatgtaaagtattttataaatagtacttcagtttaaggaaaatgggaaaactgttacagttccttgttttgtctaatggtcaaacaatattagaaatctctgcccctcgtgccaagctt

SEQ ID NO: 439 - DNA, 933 bp, Homo sapiens
  CDS (1)..(933)
atgacccatctgaagaaacttaaagctgagtgccaattctcccaaaaagaagtagatagaggagagaaagaagagactttaaccattatgttaacattgggaaaccctgcccaccatatagtagttgtcatgggaaactggagcactgtgactgaaatcaccctaattgccttcccagctctcctggagattcgaatatctctcttcgtggttcttgtggtaacttacacattaacggcaacaggaaacatcaccatcatctccctgatatggattgatcatcgcctgcaaactccaatgtacttcttcctcagtaatttgtcctttctggatatcttatacaccactgtcattaccccaaagttgttggcctgcctcctaggagaagagaaaaccatatcttttgctggttgcatgatccaaacatatttctacttctttctggggacggtggagtttatcctcttggcggtgatgtcctttgaccgctacatggctatctgcgacccactgcactacacggtcatcatgaacagcagggcctgccttctgctggttctgggatgctgggtgggagccttcctgtctgtgttgtttccaaccattgtagtgacaaggctaccttactgtaggaaagaaattaatcatttcttctgtgacattgcccctcttcttcagggccgtcagaaagctttttctacctgtgcttctcacatcactgttgtctccattgcccacgggagcaacatctttgtgtatgtgagacccaatcagaactcctcactggattatgacaaggtggccgctgtcctcatcacagtggtgacccctctcctgaacccttttatctacagcttgaggaatgagaaggtacaggaagtgttgagagagacagtgaacagaatcatgaccttgatacaaaggaaaacttga

SEQ ID NO: 440 - DNA, 810 bp, Homo sapiens
  CDS (55)..(810)
tttcgtggagtgtcaggtttcaatctcagcaccagccactcagagcagggcacgatgttgggggcccgcctcaggctctgggtctgtgccttgtgcagcgtctgcagcatgagcgtcctcagagcctatcccaatgcctccccactgctcggctccagctggggtggcctgatccacctgtacacagccacagccaggaacagctaccacctgcagatccacaagaatggccatgtggatggcgcaccccatcagaccatctacagtgccctgatgatcagatcagaggatgctggctttgtggtgattacaggtgtgatgagcagaagatacctctgcatggatttcagaggcaacatttttggatcacactatttcgacccggagaactgcaggttccaacaccagacgctggaaaacgggtacgacgtctaccactctcctcagtatcacttcctggtcagtctgggccgggcgaagagagccttcctgccaggcatgaacccacccccgtactcccagttcctgtcccggaggaacgagatccccctaattcacttcaacacccccataccacggcggcacacccggagcgccgaggacgactcggagcgggaccccctgaacgtgctgaagccccgggcccggatgaccccggccccggcctcctgttcacaggagctcccgagcgccgaggacaacagcccgatggccagtgacccattaggggtggtcaggggcggtcgagtgaacacgcacgctgggggaacgggcccggaaggctgccgccccttcgccaagttcatctag

SEQ ID NO: 441 - DNA, 1430 bp, Homo sapiens
  CDS (104)..(988)
gcacgagaccagcagctcacactgaagaagcatccttgcttgggtttgcagtcttctgcggcaggcattctcggaggaaaccagccaaggactaactacgaccatgagattggcagtgatttgcttttgcctgtttggcattgcctcctccctcccggtgaaagtgactgattctggcagctcagaggagaagctttacagcctgcacccagatcctatagccacatggctggtgcctgacccatctcagaagcagaatctccttgcgccacagaatgctgtgtcctctgaagaaaaggatgactttaagcaagaaactcttccaagcaattccaatgaaagccatgaccacatggacgacgatgatgacgatgatgatgacgatggagaccatgcagagagcgaggattctgtggactcggatgaatctgacgaatctcaccattcggatgagtctgatgagaccgtcactgctagtacacaagcagacactttcactccaatcgtccctacagtcgatgtccccaacggccgaggtgatagcttggcttatggactgaggtcaaagtctaggagtttccaggtttctgatgaacagtatcctgatgccacagatgaggacctcacctctcacatgaagagcggtgagtctaaggagtccctcgatgtcatccctgttgcccagcttctgagcatgccctctgatcaggacaacaacggaaagggcagccatgagtcaagtcagctggatgaaccaagtctggaaacacacagacttgagcattccaaagagagccaggagagtgccgatcagtcggatgtgatcgatagtcaagcaagttccaaagccagcctggaacatcagagccacaagtttcacagccacaaggacaagctagtcctagaccctaagagtaaggaagatgataggtatctgaaattccgaatttctcatgaattagagagttcatcttctgaggtcaactaaagaagaggcaaaaacacagttccttactttgcatttagtaaaaacaagaaaaagtgttagtgagggttaagcaggaatactaactgctcatttctcagttcagtggatatatgtatgtagagaaagagaggtaatattttgggctcttagcttagtctgttgtttcatgcaaacaccgttgtaaccaaaagcttctgcactttgcttctgttcttcctgtacaagaaatgcaaacggccactgcattttaatgattgttattcttttatgaataaaatgtatgtagaaacaagcaaatttactgaaacaagcagaattaaaagagaaactgtaacagtctatatcactatacccttttagttttataattagcatatattttgttgtgattattttttttgttggtgtgaataaatcttgtaacgaatgtaaaaaaaaaaaa

What is claimed is:

1. An isolated polypeptide encoded by the polynucleotide of SEQ ID NO: 335.

2. A composition comprising the polypeptide of claim 1 and a carrier.

3. An isolated polypeptide encoded by a polynucleotide comprising a nucleic acid sequence which is 99% identical to the nucleic acid sequence of SEQ ID NO: 335, wherein the polypeptide has S-adenosyl-L-homocysteine hydrolase activity.

* * * * *